United States Patent 11,549,145 (METHODS AND COMPOSITIONS FOR INHIBITING AND TREATING NEUROLOGICAL CONDITIONS) - sequence listing, part 7

SEQ ID NO: 27 - DNA, 18527786 bp, Homo sapiens (residues 6,175,930-8,234,572 of 18,527,786)
  misc_feature (4041202)..(4061201): n is a, c, g, or t
tcaccatgttggccaggatggtcttgaactcctggcctcaagtgatccacactccttggcctctcagagtgctgggattacaggtgtgagccattgcacccggcccatctcctgtttttcatttgttccataactgctgaaaatcaaccatctaccaagcaccaggtaagtcaagagacaggactcagatactgagacaggcgaagtggctcacacctgtaattccagcactttggaagactgagggaaaatcacttgaagccaggagttcaggaccagcctgggcaacatagcgagaccctgtctgtcccagctatttgggaggctgaggtgcgaggatcacttgagtacaggagttcaagctatgatcacgccactgcacactgcacctcagcctggacaacagagtgagatcctgtctctaaaaaaatacaataaaatattaaacaaaactcaagacactgtcctcaaggtcacaatagagagaggcaaagacaatcaagccagtaattgccacagggtgtgactagtgggggctgcagctgtggtttcaccaccaatcctgaggcagggactcacccctcatagaccctggtgaacgcctcatggaaccctgcactgagccttgcacagggagcactcactaataagacaccaagtgccaggaggcatttgaaagatggtgagaaggaggtgtgagaaagctccagagtttgaaagggacaggagcggaccctccaaacacggggaagcactttccgcgatttctttccctgcactatcaatgaccagggcacaggcagcccacgatcactttcgaatacaggtgcaaaaaagggcaggtgagcccacgtcagcgtgttagctgccagatctccagagggaggctcaccccccagggaagagaagggtacccaggaccctgagagccatcatcacttcacaggcagattccatctgtccccacccagagtccacaggaaaacagacttctggtaaaaatgcctcggctgtacattcagcccaccagttctgagtatctacacgtggacaggcaccgtgggttcaaaatcaagaaaaacagccaaggcctctgccctcagagagcctttgcagtttccctactttacagaaagtcaacctcaggggaatgaaggaacttagctagcatgtgaccccaagcgcagcccgtctcctaagtcacgctttgctctgcacccgctttgccagacagttctcagaactcagaactggctgagctcattgactgtcccctctactgcgtcccacagaagggtccttccccaaggtgcgcagaagcagcggcacttacccaggggcattctcaccccgcggacagtggaagcccctcagggggtgcagatcagagtgctgcaggagagagagggcgctggctggtgcgaagccgtccgaggtgcagcacagcccacaaggcctaggcaaggaaaaagcacggggagggggctttagtacaaggcccggggacagaagtccagactctgccccactggagtgctggcagcgtcttccatttaaaccacagctaactggtctgtaaaatgaaggttctaacacctacttttaaaagttattgaggggaaaacgagttaacggtctcaaggacgtggcacaatgactgacactttgtaggcaacagtcaagtggctttggaggcttccaatgccaggagtcgggggcgggcagctaaagtcgccgagccctgtttcccgccatccaggggcactaagcctccccgcagagtagctgcgcggacagggggtctgacgaccgcacgtggccggctcagcactgccgcggccaagggcgcgactcacccgccagtgtctttcccgaggacacgcgaatcctggggggctcactccggcaaagaggacgagacactgcaccaaggacagggcctgacctctctggccgccttccccggggcctcagtttcccccgatggtgagagtggagccgaccatgcgccctgctgtggactcacccggcgccctggcgtcgagtggcggcggagacctgacagacagcgtgggaaaaatcaagatgtctgcagatttcgagagatggggtgcggtggcgtgcgatggcgaaggacggcgagggacggcgaaggactgaggccacacgacaaggaagctacgctcgtttcgcgccggcggaaatacagacgagagcgcgagctgcggcctagagcggtaggaaccgacgcgagcagtcctgcagcgtcccctggcggagcggaggctcaacgccagactctggaggacttgggataattttcgaaaactatctggaagtttagaagtaaacttctcccacttgctttgcttttctgtttgttctgaagatgttccttggtcactgattcattattaatctgtaggaatggccaattttccatgataggagctgttactacgatgaggggactgtgcttagtttggacttctttctgcaagggtccaaaggcatctgtctttgattcaccactgtactcagtacctagttcagtgactagcacagttgaatgaatgaattctacccccgccccattcctttttttctgaacaatgtcagaccgagatgactgagtcatggcctgagactggaatgtgagcgtgagaagatgagccaagagagatgcacagcgggtaactgctttgctaaactccagcctcaaagtacacgggatggagggtggaaagagtctctgaagcagaagagacctgaccagactggcatctgaggaacctgatcagatttgcacagtgacagagactatagacagatgtcccatgttccctgcaacatactggagacaatcttgggaggggactcatggcccacaaatcctcataagcattggcactgcctgcaccctgggcagggtgtgcctcttcggcctgagacagccctgctactgactctgcccatgttctggagtgcaagcagcccacccttgggcctgatgaggagcccacgccccaccctccgccccgctccagtcagattcttggtactcaataggtcagaaggacaagaaaatccagtcctgatctatgcaaccatgagggaaatgggggtccctgaggtgagatctgctccatattttgtacctgggagaggcccatgggattcccagactgtgagaacactgggagtctctgtgatggggaggggctgtgggatgctgctatggtttggctgtgaccccacctaaatctcatctggaactgtacttcccataattcccacctgtcgtgggaggtaatggaatcatgggggtggttacccccatgctgcggttcttctgatagtgagtgagttctcatgagacctgatggttttataaggggctttacccacttttgctctatacttctccttgctgccaccatgtgaagaaagacatgtttgcttccacttccgccatgattgtaagtttcctgaggcctccacagccatgctgaactgtgagtcaattaaacctctttccttcatgaattacccagtctcaggcagttctttataacagtgtgaggatggactaatacagatgctgtggctgagaggacactgggcagggtggtcaggtgtgcccacttgtggccacacagccctggtgtcctcttctgcctcccactcttgctgttactctccatgtgactttggctaagtgacctaacttctccgccccgcctcagtttccagttatggaaaataggcagtcatagttccctgctcatagcgttgctgtgagaattaaatggaatgatttatatcaagaccgtagcacagaacaaatatccaaggcctagtagttgctatattatagtatttctgagaaagctgagggcttctgtcaccgtaaggactctgggattctttatgaagcagaggaaatgtgctgtgtttgaaaagtctaagatggcattgtcagcccggtgtgatggagcagtcctgtagtcccagctactcaggaggctgaggcaggagaatcacttgagcctgggaggttgaggctgcagtaagctgagatcacaccactgcattccaggttgacagaacgagaccctgtctcaaaaaagaaaaagaagaagaaagatagcattgtccaatagaaatataacacaaggccgggcatggtggctcacgcctgtaatcgcagcactttgggaggctgaggcaggtggatcacctgaggctgggagttccagaccagtctgaccaacatggagaaaccccgcctctactaaaaatacaaaattagtagggcatggtggcacatgcctgtaatcccagctacttgggaggctgaggcgggagaatcgcttgaacccgggaggcggaggttgcgttgagccgagatctcgccattgcactccagcctgggcaacaagagcgaaactccatctcaaaaaaaaaaaaaaaaaaagataaaaagtaaaagtaaaattaattttaataatttaactgaatataaccaaaatattatcatgtcagcatgtaatcaatattttataattattcatgagctatttactattctttttcttgtatgagatctttggaatctggtgtgtgatttacatttatggtacattacaattccgactggccacgtttccagtgctctgtagtcacatgtggctggttgctgctgtgctccccagcacagatataaggcaatctggctctcatcagccctttggagctggaagagacacagcaaacagtaggctgagtgcatccacaacccacacccacctccgccgccctacctatgagcctgaaagggcttggcctcctgcatattcagattgaggcctcaccaggctgaatcttctgggctggcaattaaggccaaggtgccctcagaaagctgggaacgggcagaactgcagattttctgtagttccagattttcttttgcactccttattctcataacactaaggagggcaccttggcgggttcattcctgcagccccagtgcctataggaggatggacacctaagaggagtggttcatgcttgttccacggtagtggaacaggatgttaaattagccgggcgtggtggcgggcgcctgtagtcccagctattcgggaggctgaggcaggagaatggtgtgaacccgggaagcagagcttacagtgagccaagatgacaccactgcactccagcctgggtgagagagcgagactccgtctcaaaaaacaaacaaaaaaaaggaagtttcagctgacaaatgacaaggtcaggagttcgagaccagcctggccaacatggtgaaaccccatctctactaaaaaatacaaaaattagccaggcatggtggtgggtgcctgtaatcccagctactcgggaggctgaggcacgagaatcacttgatcccaggaggcggaggttgcagtgagctgagatcacaccattgcactgtagcctgactgacaagagtgaaactccatcaagaaagaaaggaaggaaggaaggaaggaaggaaggaaggaaggaaggaaggaaggaaggaattgaaaatccaataaaattgctgttgtgataagcaaaaattgatttgagtattggcagtttttgaagtttccgtgataaaatagcagctgccttccaaagaaggtgctggaccaaatgcagaactgaggaaggagataaccgaaacatcgttgcttgtgactcttgaatcttctcttccaattggagggtagtaatggtacagtattagaaatgaaaaagaaggcgaatgatgaattgtatttcttatgaaaaagcaagagctgtgagtctcaccccctgcccccaaaagggagagacagggagggagcccgtgcatctcaccttaactcattaagaagcactttagcaggtcacaagggagcttgacatttgtcactcaaagttggggagcacaggtgactggggcccaacccactcctgagtcaaaggttcatagtctctttctgtaggagtagaatctgtggtatgaatgtctgcctgggacccaggaggtcccatccatgagggaacctgctagggtgagggaattccaagaagagggtctgtgcacacatcagtagggatgcaacaggcaacaggaggagtctctctgaagagcccatgagaaaggccacaagatcaacctctgagaagcctgggattgatagggaaggccacaagagaaataatcaggattaaacatctccctagcttggagagggcgcgggcttcttacaaaagcaacagacaagagacgtctccccgctccttaccctttactctacctgtttttatcctggaagtattgagagtgggtaagtggacagaaaattcctgttgaagagaaacatatctggatacatgaagagagaagccccacgtccctaccccagcctatcccgtacttagccccagctggtggagagaagtcttacctatggaagatcattgaaaacatagtaatgcgttagactgaacatttaaacttgttgaatggattcagcagatccttaactaatcctggtggggtttttttattcttttttgagacagattcttgctctgtcgcccaggcttgagtgcagtggtgtgatctcggcttactgcaacctccgcctcctgggttcaagtgattctcctgcctcagcctcccgggtagctgggattacaggcatgtgccaccacgcctggctaatttttgtatttttagtagagatggggtttcaccatgttggtcaggctggtctcaaactcctgacctcgtgatccacccaccttggcctcccaaagtgctgggattacaggcgtgagccaccacgcctagcctttttttttttttttttttttttgagactgagtctggctctgtcgcccaggctagagtgcagtggtgcgatctcggctcactgcaacctcccactcccaggttcaagcaattctcctgcctcagcctcctgagtagctgagattacaggcgtgcgccaccaagcccggctaatttttttgtatttctagtagagatgggatttcaccatatcggccaggctggtctcaaactccgaccttgtaatccacccgccttggcctcccaaagtgctaggattacaggcatgagccaccgtgcctgaccctactggtgtattattaaaaaataataaaataaaattgttgaatggaaactgtgttttccatttttagtgattgcaagactttttattacctaagaatgatcagagaaattctaaggcttttgccttatatttttctaggggcaggggagagacgctcccacttagcaagtctaagcagacatatcaggagtcctgctttcaacatactcgttgcaaaggattggactgtagctgggaagacaaggttccaccacaggaagtctgtgacctcatagtggctgagaaatccctggggcctggagccccttcaccagaagagatggaatcatggctggctggacagcttcttccaaggagttggtgcccggagtctaggtgggaagtcagcaactgaccatgcaaggcctgcaggagctccagacccatctccacaccaagagtgaccaccgtgctgcagattttgttgtatctgtccattctcctcctcggcttcttactgctcctctgttactgcgtctttcagtagcccatttgggtgatgagcactctctgggggtgctatgggggcatctttggagcttggcagcagtgtgctgtgatagaaaacaggtagatgggctgggcgaggtggctcacacctgtaatcccagcactgggggaggccaaggcaggcagatcacttgaggtcaggagtttgtgaccagcctgacaaacatggtgaaatcccatctctactaaaatagaaaaattagccgagcgtagtggtgggtgcctgtaatcccagctactcgggaagctgaggcatgagaatcgcttgaacccaggaggcagaggttatggcaagccgagattgtgtcacttcactccagcctgggcaatagagcgagactttgtctcaaaaaataaaataaaatgaataataaaagtaaattaaattaaaaatgaaaataataaaagtaaattaaatttaaaaataaaacaaaatataaaataaaataaaaatgatggagcatcagagacgcttgggtcccaatctcctctgccacaatctagctctgtgccctattctttttttttttttttttttttttttgagacagaatctcgctctgttgcccaggctggagtgtagtggtgcaatcttggctcactgcaagctctgcctcccgggttcacgccattctcctgcctcagcctcccgagtagctgggactacaggcgcccacgaccacgcccggctaatgtttttgtatttttagtagagacagggtttcaccatgttagccaggatggtcttgatctcgtgacctcgtgacccgcccatctcggcctcccaaagtgctgggattacaggcttgagccaccgcgtccagccactctgtgccctattcttaacctcaatttactcaccccaaaaacaaagctgtgagagaaaggaatttctactattgttgttgttattgttcttataactacaatcctgatcttttccaaagccaagatatttccctctcttttaccagaagtgtgttccctttaattccccagcaaggaaattttacagggtttggagaacagggtggccgttgctgggctctgtgctcactgggctgctctttcccatgctggccgttggcatctgcctcccgcgctgtctcatgctgtgctctctttctgtgtctgcatttgaaagtgatcatcagctagcctgtgtcttcgtcatcgatagtacaggccggtgaactgcgcaaagcattttctgcatttggagggtccatctctatccttggaaatgctagtgcttttctcacattcgacttctcttctgtgaacactctcaagcctctggggcattgtgggctgtcattttgtttggcctttctcagcttgacttcttggcaaaaattaggctgtgtatatctgggactatttgttgcccaggacaagattaactactcaagggatggctgaggctcacagagcatgagccctgcacagaagaggtaacatttcaccagccaggtgaactgtacggaaattaacaattgagtgtatgaatacatacaacattgagtatagatcgtgattatgataggatttaaagaaagatggcttcttggagatggtgtgctttggtggttttctgtttgtttgtttttgttttttgagacatggtcttgctctgttgcccaggctggaatgcagtggcacgatcagagctcactgcagcctcaacctgctgggctcaagcgatcctcctgcctcagcctcccaagtagctgggactacaagcacatgtcatcacacctggctaattaagaaaattttttttgtagagatgaggtctcactatgttgtccaggctggtctccaactcctgggctcaaacgatcctcccacctcaacctcccaaagtgctaagattgaaagtgtgagtcatcgtgcttggaccttggtgggtttttctttttttggagacaaggtcttgctatgcttctctggcctcaggggacccttctgccttagactccctggtagctgggactacaggtacacaccaatgcatctggctcttggtggatttttgaagtactcaaataggagtcctttaaagttgcaatgggaaggctcttaagggtcagggggagaaagaggaagactctgaagctgaagaggaggaagggatgggaagtggacacctgtgctggtatgtggataagttaggaaccggagggggcagtatccccccatctcattgcatggcctgtaatagatgatctttaaatgttgatgcaaaagaagaaagggaaatgctcattgtggcaacaggagagggctcacttaattctgaaatgtaagaaaaattacttgtgtcccagtctgctcttggctctgagggcttaaaaaaaatgaaaaaaggctgggcgtggtggctcatgcctgtaatcccagcactttgggaggctgaggcaggtggatcacttgaggtcaggagtttgagactagactggccaagatggtgaaaccccgtctctactaaaaatacaaaaattagccaggcatggtggtgggcgcctctcatcccagctacttgggaggctgaggcaggagaattgcttgaacccaggaggtggaggttgcagtgagcgcactactgaactttagcctggtcaacagagcaagactccatctcaaaaaaaaaaagaaagaaagaaaaagaaaaaaaagaaaaaagcaggacaacttaactgattcgaataaaataaaattagggccaggcatgatggctcacacctacaatctcagcactttgggaggctgaggcaggtggatcatttgaggttaggagttcaagaccagtctggccaacagggtgaaaccctgtctctactaaaaatacaaaaattatctgggtgtgatggcgtgtgcctgtaatcccagctaatcgggaggctgaggcaggagaattgcttgaactcgggagacggaggttgcagtgagctgagatcacaccactgcactccagcctgggtgacagagcgagactttgactcaaaaaacaaaacaaaacaaataaattaatgaaataacaaaagcagaaaacgagcatagggccaggcctggtggctcatgcctgtaatcccagcatgaaagtacatcaataggaaatgtatgtcagtgttgtggaacaacatctcaaaaacccttggaggatgttatggactgaatatgagaccaaggcaagaggatcgtttgagaccaggagttgaagaccagcctggacaacatagtatgaccccatctctacaaattttttttttttaattagcggggcctggtggcatgcgcctgtagtcccagctactcaggaggctgagacaggaggatcgcttgagcctaggaggtcaaggctgcagtgagccataattgcaccactgcactgcaagctggataacagagcaagaccctgtttcaaaaaaaaaaaaaaattggcaggcttcagttggaaagtcttggcctcagtgcccttgaagggcaggagtagtgcttctgccttgtgaatgccttctgaccccaccaatggggagaggtggacacgagagctgggcagatggaaatcagttgtatctttatcaatggtgacagctggatgtgaccacctgcaggctccctgacacctgctcctccttcctttacctctgttgcagcccaccctccaacccctaccacatacactgccatgctggatagtgcctgccgggtgagcttactcaggaaggagtggggactcagccaaggatcccatgaacaagcaaagcacagacaccctgaggggtgtgcagcctcaacaagtcctaacccacactcaagacaaattagatgagggacctcagagatgggtgactcctcccagagctccagaaagggtggaagtgcctatccttggcccagaaggtaattttgagaattgagagcttgagtgtgaaaggttgtaaaaatcaggccgggcacagtggctcacacctgtaatcccagcacgtgggaggccgatgtcaggcagatcacctgaggttgggagtttgagaccagcctggccaatatggtgcaatctactaaaaatacaaaaattagtcaggctgtggtgatgtgcgcctgtaatcccagctactcaggaggctgaggcaggagaatcccttgaacccgggaggcagaggttgcagtgagctgagatcacgccactgcactccagcctgggtgacagagcaagactctgtctcaaaaaaaaaaaaaaaaagtttgtggaattcagaatagcatttctcagaaagccccgctactgcttgcaaacctttttttctaatgaccgtgcacaggtttcactgtcacaggtttaattaaagtcttctgcttgatctcaagtagcgtggagaaaaaattcctcaaaagtgttgccattcagagatattttcaagggactttattagaaggaccatcatttaaggatgagatggtatgacagagggtgactctgctacaccagggaagaacatgctagggaaaacaccttctttcttttaagtcaagtgttttctgtgtcatcagattgcccaatcatccctggcatctctgcttctcaaccataggctatgatgtgtatggtgctcccatgagttgtgcagtacacgacctgcacaaccatatgtggcagtcctgcctaccctcaatggaagcaggatggagatgttcccctgggtaaacgtggcatatgtccctcactataagcaaaaaatcagagcaagtgtgaagtcagaagtccacccagagagagaggcagagttgcaggacagggatggaattccagttctggtgtttgttgtcttggaggcccagcttgacctctgcccttcccttcgcttgattatataagttttccaataatgtattttatttttaaagcgtaagttaggtttctatcaccaacacattctatctaaaagcccaagtcttttccttaacttgtcctaaatggccagttattaagaaattccattgagggtttggctgttgcatacagccttgtgggcattttgcttatccacgttgactttctcatctgggacactggcctacgtagtacgtgattccagcaaacagggcagtatgttgagctcttgaaataagtatgttgtgacagcctttgttacagcattaaaagaacagtctactctcaatggctgaccctttatttgtatgctgacgtcaaaaacaaaacaagactgcagacacactcttgccaatgctagaaaggatgcatgtttgaagtggatttttttctatttttttgcttggagaggagggtgtgtggacaccaagctggccatggtccaagctgacctatttgccagccgacccctgtctgggctgccataacaaagtgccatcatgaactgggtggcttataaacaacagaaatttatttctcacagttctggaggctaaaagtccaagatcaaaggcaccagtagatttggtaaactaggaagcggtgagggcccacttcctggtttatagactgatggctgtcttctcactgtgtcctcaaatggaagctgatgtttcacaaatattttctgggtaaatggatgggtgagtgaactcatgaagggatgctccattagatgaacgcttggataaagggcgttagtggagggacagaattgcagctccgtcctcccagggggcgctgcaggcacgtctgcttgggcaggggcccggcggaagcgccgctctaggctgcagccgcgcccccagccgtatttccgcgggcgctgagcactagagagagcgtcttgtggctgcggcctgcccctcagcctcctccgcgcggttacccctgtacccgccgccatccgtcctggcgctccggatgagtcaatgaggggcagggcccgaggagtggtcttcccaagaacccctggtggcctcccaaggccggtgctgtgtacctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgagggggctagagacctcgcgacttttactcccccgaccccgatctccgactcctgactttggaagcccccaaagctgcttttcggttgcctacaaagtgtcggtcattgtgccacgtccttggaaccgtgaactcattttctcctcaataacctttaaaaagtagctgtaaaacctccattttacagaccagttggctgaggtttaaatggaggacgctcccagggccccagaggggcgaattccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctgggtaagtggtgctggtcatgagcactttgggggacccttcaaattcccttctgggggaccccagcggagggcatggtcatgaattccgagaactgtatggcaaagccgggtgcagaggagagcctggctaagttctttcattctcctgagcttgactttctgtaatgtagggaaactgcgaaagctctgtaagtggggagatcttgcacgtttttcttgcttttgaacccatgatgtctggctacttgtagatactcaatatttgtgggatgaatgaacaatttaagccttttttttttttaaccagaaattggtcttctgtgactttcttgatgggggcagatgagatctttgtactgcattaagtggatagcgctcaggtcctttgggcttggcgctttggcaatctccaggcagctcactttggcctctgttcctggatcccctttgctcttttctgcgcctgcattcgtaagtgatcacgggctgcccgtgtcctggtcattggtagtgcaggcagaggaaatgcgggaaaggttgctgtgtttggagggtccacatcttcaccctcctgtcccaggagctttcctacactcctccttctcaaagctgcacacacctggggcctccaggggattgggggctgccgtgtgtgttatatcatgattagagctttcacttcctgctccctgctgttgggaaccaggctgtgtgtgttgcttaaattccccttgatgaccagcagagtcactgccactcagccatggcacactgctgtaaacctggttttgatctcctttcaatcttttgctgattaactacacattgatcagtgttggccaccctcaccctgccatagaccatccgctgtcttcctctgtagagttaactattttctcttttatgaggaaatagtgtgtttgcttaggagtgtttactgtctggtaactactgtgctaagccctttcctgttgcctgccatccctgctgcgagcagggacaagctgggtgctcactcatggcatcttatctgttgcagatagtccactgtgtgcagaggcatgggagttgtcatgttgggaacatgctagacctcagtatccttgaggtaagatctctggttcattctctggaatgttggttccttgtatctagtacagttctgtacatgttcccaggggctttggggttggtgtaggggagctgagaggtgagatgagaatggcactgtgggtccccagatccgctgtccacccagccaacccagatcacctctggcctttcctgtgccttccgggcttgctgctggggggaaacctccagagtcccactttggtaataagaggtctctgccctttctccctgggcagcaggatgttgtaatggaaaatgagtggacctaggcttcagagactctggtcccctggctttgaatccccttctgccactatcccagtcaaggactgattcagaacctaattttcttcatttggaaaataatgttctgatagaggtgacttttgtggtacttgagaccatatgattcctatcattaccaaccaatattttccgattgtttttgccccatgtgacttctctgtgattcctcctggcaaggaagttttacaggaaagcagggccacttttgggatcctgtgctgggctggatcattttcctggactggacctagtccacaagctgctggcatctgtttctcctcatggatctctctctgcccttgtatacacctgcattcaaaaatgatcacgggctgcctgtgctctggtcatcaataacgcagggagaggaattgctgaaagccgtttcccgtgtttggagggttcacacctgtccctttcaaatgctggcgctttcacacactccttctctcctgccagcaccttctggtctcaggagcattgcaggatgttgtgtgagtgagtgatgggagacactttagtatggcttttttcagcttagcctcctgttatcagagagcagtctctttcagtgtcaaggtttgagtactagatggtggagaaagcctgtgtgaattatttttaatgaataagtgtgatgatgggtggcatacagtcactgccttaagattttcaaagagaagcagccttttggaggtggtgggcctgggcaggtctttcaaggagtgggatgtgatgggcagtagaaaggtattccagggaggggtagcaacatgagaaggtctttcaaggattgggatgtgatgggcagtagaaaggtattccagggaggggtagcagcatgagaaggtctttgagtctgggatgagcaagagtgtctagtcccaccagggagacagatgtgtaggcaagtaatgacagcatggagggatggctgctggggtgatccttggctcccagcacggcgaggtggacatctatgggaggggccctgagaggtctcttgagctgtctttctgccagttgcacatctgctcagttgcctgttaagactcttaagacagttttgctggactcttaagtttttattttgatattctttgggagcattgagattcctttttgagatgagtttggtatgaaagaaactggcaactcatacctgattgattaactgggggcattcccattgacatcagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatggtaagtgaatgccaagaggttaagttggcctgtgtttccgaggtggaaattccaggtcgctggcttcatttgtcttctcttttagattgtttgggggttgatcacagaccaagagtgacgagtgatgtcaccctgtgactcatggctggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgccctgctgcttgttctttcatttttgtgtgtttggtttttttttaatcagtatctccgtgtgccagcaagactgggtgtagagagtgggtcacaagggcaggtcttctggttctcactcattaagactttccccttgacacatacccaaggcttgacctagggaatgtgagatgggacgtgggatttggaccggggttgaacaataatcccaagtgcatctaggggtgggggggttcaggcttaggagagaaggggaactcttaggattaagttggcaggggaaacatttgagccaaggctttgggagagaagactatgacgggataacttagggatggaggcaggggctggagtccttgaagaatgcaagagtgccctgagctcaggtggtggattgcaggtgaatgtaggagttggttttgagcagaggagagagtggagtatatgaggaatagctgcacttggagagctctgggggtgtggcaggcagtgccagccgctggggcttctgttaccatgagatagatttggtctttggggattctctttggtagcagtgatcgcagtgatgtgcttacgtgtgcattgtatgtgtgtcaccacctccatatgttgctctgtcctcatttttcaggtaaatttcacacaagaatgctcccaaaggctatggtagaaagttgggagtcagttggtcccactccttcagttgaaatagaaatcactgtgactaagccgggcatggtggctcacgcctgtaatcccagcactttgggagtctgaggcgggtgaatcacttgaggtcaggagttcgagaccagcctggccaacatggtgaaaccccatctctactaaaaatacaaaaattaggcatggtggcaggcacctatattcccagctactcaggaggctgacgcaggagaatcatttgaacccgggaggtggaggttgcagtgagccaagattacgccactgcactccagcctaggcaacagagtgagactctgtctcaaaagaaaaaaaaaaaaaaagaaataactgtgactagggttgagggaaaccaggctgtcaggcatctctgatgacctctgccagcaggagacattcttggctgaagagtccgctctgccagccatctctggcgagggccttatttctgcattgcccccctccttattcctacccaagaaccacctgacacctctggtttgctctcttgaagatccccccacctgctgcaacccctctctagccggttttatccaactgtggcctttgtcctttagtgagaaatgaccacatttcccccaccaaagaaagggggccaaaattctccccttttctgagtccactatttttagtgaagttttacactggttggtgccttgaattggtagacctgtctttccttagcaaactgacccctctcatagctaagcaggttcctgtcagctaataggacaagtgtctacactacactcccttctttaatctctcgttctctttctctctctctcatgctcttcttgacccactacctcaatcctgcaacctgggggtcccttacgccctttttagtttgttctatgggaggcaacaatgatggagtactgaaaaacaagggaagaggtgagattgccacgcagtgggggaagagagtgtcagctatagagataggatcacttactgtggcttggccccctggcataaaagttttcttactaagccagactggttgatttgtggagggttccctcatttatcaccctattttcatgcatcctagtggttgctggctggatgtgaaggttggtgaactaatatgttagaagctcttagcatagcacttggcacataggaagtgctcgatgaaggatagctcctctcaatcactagaacttcctttccaattgtaaatggtcctcatcgctggcccagcctcttaggtctttcttctcctgccctctgccaccctcgcccgaccctaccctcagcctctagcctagacttcccattctcccgaggagacagcaaggccctcctcactctgcctgtggcctgcctgtccacccttttctcacacaagcaccctaggcctcagccacccttctgcttaaggtccctgaacatgttcttttcccggcctatgcgcctggaatgcatcctccgcttcaagctcagctgactcagcttgtgtcactttcttcaggaagcctttgctggcggaacctccacccagactggattccccgcccctccttccattcatatcaattatcagttctgtgcaggcacaattctaggaactggtaaacaaaacaggcaaaagagcaaatccctgctttgtacttacattttggaggacaaggacatatcataaaacaaagtactaaaataggtagaatgcttgagaaatgttaaggaaaaaaagtcataaagcagggaaacaagataggaagtttggggaccagcagagggagtggcattttaaattgagtagacacgacggcctccccaggaaggtgagatttgactaaagtgaggagctctcactgctgggcgttcactgcaggctgtttaagccgccatcactgcatggaccatggacaataggaagctttttcctggccgagcgtggtggctcacgcttgtaatcccagcactttgggaggctaaggcgggcggatcacgaggtcaggagatcgagaccatcctagctaacacggtgaaaccccatctctactaaaaatacaaaaaattagctgggcgtggtggtgggcgcctgtagtcccagctactcaggaggctgaggcgggagaatggcgtgaacccgggaggcggagcttgcagtgagccgagatcgccccactgcactccagcctgggcaacagagcgagactctgtctcaaaaaaaaaaaaaaaggaagcttttcctttggataccaggttcagtgaagtggggagacaacaggcatctgaggccactgcagtgctgcttctgattatgaacgtttcaccatgttgtgaaggtgcagctgaatcaagccaggattaactggtcagcacctggatgggtgtgtctagaggccaagctctgcacctgtcagctccccatccccctcacctccaaccatagctcagtggtctagggaagctcagtcacccaaggacagccttgataggcctaacccatcaccttggtccaggacccatagcagtgatcactgagccctgcagtgtttctgctgggagagttctgcatgtcaagagactgagtaattggttgcagaaacaggaagagacagagtaattaagtcttaacagcagcctaggagcatagaacattgagctcctgttgcaagtttctagaactcacaggtggagaatgaaatttcagtttccaaaccacgttcgtgctcctccaggcatgactgtgagcagtattctgatttgccatgaggcctggggattcagttttttctgaatttttataaggcatggctatgtgaccaagattccttttcgtttttttaaaaaattttttagtttattttttgagacagtcttgctctgtcacctaggctggagtgcagtggtgtgatcttggctcactgcaacctttgcctcctaggttcaagtgattcttctgcctcagcctcccgagtagctgggattacaggtgtgcaccaccacacccagctaatttttgtaattttagtagagacgaggtttctactaaacccccgtcacgttggccaggctggtctcaaactcctgacttcaagtgattctcctgcctcggcctcccaaagtgttgggatgacaggcgtgagtcaccatgcccagcctgtttttaattatttatttattttaagacagggttttactctgtcgcccagtctggagtgcagtggtgcaatctggactcactacagcttcaacttcttgggctcaagcaatcctcctgcctcagcctcatgagtaactggtactacaggtgtgcgccatcaggctgggctagtttttgtatttttttgtagagatggggttttacattgtttccctggctggtctcgaaatcctggtctcaagtgatcctcccaaattggcctcccaaagtggtggtgttacaggcatgagccaccacacatggcctctttttttttttttttttttttgagagcccttacattcactacttccattactaaagggagcaaaatgaatcttttctcattatagtcaaaaagcataccaacataatgcctgacgggtggaaggtgctcagtcaacatttagggatgaggaatgataccagcagatgccttgatagtgtgcgccagaaatgactcatgcaggcccctctgcctctgtgggtacgactgataataggtgggcctggtgaagtcactaagaatctgatgtggctgggcaaggtggctcgtacttggaatcccagctacccaggaggctgaggtggaaggatcacttgagtccaggagtttgagaccaacctgggcaatacagtgagaccctgtctcaaacaaacaaacaaaaacacacgaaaacctgatgctgtcacttaattgctatggggcctggagcacattattttgcctccctgaccctcagcttctggctgtctaatttgaccatcaacatagcacttaccccaaatagcaatgatgaagatgatgcatgttaaatgcgtaacatagtaactgccttgcacggagtgcttgataaatgtctgctgtttttatttgatgagcacatatagcttgttgatagttaaaatgaagaacaaatataaaatgtcattatgacaggctcatctgctaaggcaccacaaatactttcttctttcttgtttgctaatttgcagacatcccagcggggttggtgttagtcactgctaccattgattgaaattctgttaagtcccacgcactgtattaagcctgtatgtataattacctcacttaatcttcacaacaacccagtgaggtagatttaattattttccattttacaaataaggaaaccaaggctcaaagaaatggaagagacctgtctcacacctaatgagtggctcagctagttttccatttcctgctgtattaaatagtgaaaaatgtttcaggctgactgatttcataaatagcataagcataccaagcttatcagatgcttgtttgtactggaatactggaaattaggatattttactatttgttccatctgcttcaaattattgcctattatttagagttgctgaaatagtcttcatctaaatcagtggttttgcagattgaacttatgaacctgacatgtacagggacaatagccatgttttagccaacaccaaaatatcaagtgtccttcccactactgttgtgtctgaagcaagagtcatccaagacccacagaacttgaggaaacttgagaagggtatcaccaatgtggcccaataaccaggattagcatcaagaagagccacgatcctaccaggaaactgttgcctggcaccagagtccctgtgacacagtgggtgggagattccacggcagaattgagccaggagaatgaagaactggacagaatgaaggttcatttgtccatccaaaagatatttattaggcactgtgctgggaatagagataccatgatgaacaagaaagttgttgccctcaagaggatcgcataaacgtgtatagatgataagttatatgaattcacactccagatacttatggaacaatcactatgtgctgggccttgctctcagatgggcatttgggtctgaacaaagcaaatgaaggagtttatagtataggacaatgctgtccagttaaaaaaataatgtgagccacatatataaaatttcatagtaacctcattaaataaaaagcaggtgaaataaattttggtaatatttatatattttatttagcccattacatcaaagaatgttgttatttcaacacgtaattaatattaaaaattatcattattattattttgagacagagtctcgctctgtcacccaggctggagtgcagtggtgtgatcttggctcactgcaacctctgcctcctgggttcaagtgatccttccacctcagtttcccaagtagctggtattacaggcatgtgccaccttaccctaatttctgtatttttagtagagatggggttttgccatgtttgccaggcgggtctcgaactcctggcctcaaatgatccacccgccttggcctcccaaagtgctgagactacaggcatgagctaccttgcccagccaatattaaaagttattaataagatttttccccaaatgaaatctttgaaatctggtatatattttatacatacagcacatctcagtttagactagccacatttagagtgctcagtagccacatatggcgagtagctatcttactggacatcatagatttagacaataaggggttcaaggatgcctcctttacaggaaggctgctgcatcttgtgggggcttaatgaagctgctccagcttggatcccccattctctggtatcccctctcctccatcttggcagagcagggcgaggtatatatcaggcatgcctgatggaatcctgcctcatgttccagagccttctggaggcaagacaccgagtcctgggtgtgcttctctaacacagatcctactggagttaactttagtgtacccagcgtttgttattcagtcagtcactacctgtttactaagtgctggcctctgtgctaagcactgtgaatgcacgccagtgaaaacagacatttgttagctcataatttcatcaagataaacaagatgcataaattgttaaaaactctgagaaattctacagaggaagagggaaaggtgctgcaagagtaaatagggcacctgacctcttgggagtcagggaagtagacttaactgagcaaaggaggagagtggtccacatccaaaagctgcgtggaggatgcagggaggagctcaacggtggttggtgtggctggcatgcagcccggagtggtgtgagcactggctttggagtcacagatctggtccaacttaactgggtgactttgatgacaagttttaaactctgtgcgcctcagtgacctcctatagagggatgtggtgaagattaaacagattgatgtttgtttttttaagacggagtcttgctctgttacccaggctggattgcagtggtgcaatctccactcactgcaacctccacttcccgggttcaagctattctcctgcctcagcctcccgagtagctgagattacaggcgtgcaccaccacacctggctaatttttgtatttttagtagagacggggtttcgccatgtttcaccagagtggtctcaaactcccgaactcgtgatccgctagtcttggcctcccaaagtgctgagattacaggcatgagccaccacgccctgccatgagcagctattttttttttacataaaacttttattttggaataacttcagatttacagaaaaatttaaaacctggtacatagagttcccatatgcccttcacccagcttcccctaatattagcatcttatgtaaccatgacacatttgtcaaaattaaggaattaacactgatacattaccattaactgaaccacagactctatctggatttcgccagttttcccattgatgtccattttctctgccatgcagaatagcacattacatttagttatgtatccttaatctcctccatctggaatggtttctcagtcttcctttgtttttcatgaccttgacagttttaaagtgttggtaagatattttgtagaatgtctctcaatttggatttttctttttctttttcttttttttgagatggagtcttgctctgttgcccagactggtgtgcagtggcacaatctcagttcactgcagcctccatttctcaggttcaaacgatactcatgctttagcctgccgagtagctgagactacaggtgcgtgccaccatgcccggctaatttttgtattttgttttgtttttttgagatggagtctccctctgtcatgcagactggagtgcagtggcgggatctcagctcactgcagcctctgcctcctgagttccagtgattctcctgtctcagccccctgggtagctgggattacagacgtgcgccaccatacctggctaatttttgtatttttggtaaagatgggccttcacatgttggccaggttggtcttgaactcctgacctcaggtgatccacccgcctcggcctcccaagtgctaagactgcaggtgtgagccacctcacccggcctaatttttgtatttttaatagagacggggtttcaccatgttggccaggctggtctcatactcctggcctcagggatcttcccaccttggccttccaaagtgctgggattacaggcatgagccactacacccggccctcaatttaggtgttcctaacattttctcatgattagactggaggctacgggtttctgggaagaatactccagaggtgaaatgcccttctcatcacatcatatggggggtacattatatcaatgtgactcatgatcagtgacattaaccttgatcacttggttaaggtggtgactgccagacttctttgctgtgaaattcttatttttcccttttcgtaccgtaatatttggaacataggtttgattttaatagatattttaaaaatatatatttagaaatctttacccacactgagagaatgtatatatttttctcaagcacctttggggtatgtattaatattgtttgcatatttacaatatttacaaatatcatctacagcatagaatgtggtaactttgatgctgcaaagcaagtctcaaatattaataccagcacatcagtatcaggaataaatgggctgggcgtggtggctcacgcctttaatgccagcactttgggaggctgagtcgggtggatcacctgaggtcaggagtttgagaccagcctggccaacatggtaaaaccctgtctctactaaaattataaaaatcttccaggcatggtggcgcgtgcctgtagtcccagctcctcaggaggctgaggcgggagaatcacttgaacccgggagatgaaggttgcagtaagctgagatcttgccactgcactctagcctgggcaacagagcaagactctatctcaaaaaaaaaaaaaaaaaaaaggaaagatgacgactgcaatatgtcactacaatgtaaagtctaaataaaaacaaaacaaatgttaaaaatactcagacctgaagggtaatgaaaatactgtattatcaaaacttgtatgatgtatagctaaaacagtacataggagaaatttatagcctcaaatgctttcattgggaaagaacttcccaccagtaagggagtgtgtgactcattacacaggttagacggaagttcagagagttctccctggtgtctttggcatttctccaggatttttgcagcactccgagggaatcagagccccagtaactactgagattgaatgagccactagtgcagtacaatgcagacacagaacagattatattttattccacaaagaaaaggaatgagatcttttcccaccttacctttgtgaaatatgttccatttccattggaggtgctgaaggaaatcaggttttaagtcatgttttatttagatctgctagagagactgtgttttgtttttctttttttttttttttaattgatcattcttgggtgtttctcgcagagggggatttggcagggtcataggacaatagtggagggaaggtcagcagataaacaagtgaacaaaggtctctggttttcctaggcagagtgtttgtgtccctgggtacttgagattagggagtggtgatgactcttaaccagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggtgcccctcacctcccggacggggcggctggccgggcagggggctgaccccccacctctctcccagacggggcggctggccgggcggggggctgacccccccacctccctcccagacggggcggctcgcctggcggggggctgacccccccacctccctcccggacggggcggggagctgacccccccacctccctcccggacggggcggctggccgggcggggggctgacccccccacctccctcccggacggggcggctggccgggcggggggctgactcccccacctccctcccggacggggcggctggccgggcagaggggctcctcacttcccagtaggggcggccgggcagaggcgcccctctcctcccagacggggcggctggccgggcggggggctgaccccccacctccctcccggactgggcagctggcctggcgggggctgacccccacctccctcccggacagggtggctgccgggcggagacgctcctcccttcccagacggggtggcagcagggcggaggggctcctcacttctcagacggggcggttgccaggcggagggtctcctcacttctcagacagggcagccgggcagagacgctcctcacctcccggacagggtcgcggccgggccgaggcgctcctcacatcccagacggggcagcggggcagaggtgctccccacatctcagacgatgggtggccgggcagagacactcctcacttcctagatgggatggcggccgggaagaggcgctcctcacttcctaggtgtgatggcggccgggcagagacgctcctcactttccagactgggcagccaggcagaggggctcctcacatcccagacgatgggcggccaggcagagacactcctcacttcccagacggggtagcggccaggcagaggctgcaatctcggcactttggggggccaaggcaggcggctgggaagtggaggttgtagcgagccgagatcacgccactgcactccagcctgggcaccattgagcactgagttaacgagactccgtctgcaatcccggcacctcgggaggccgaggctggcggatcactcgcggttaggagctggagaccagcccggccaacacagcgaaaccccgtctccaccaaaaaaatacgaaaaccacgcaggcgtggcggcgcgcgcctgcaatcgcaggcactcggcaggctgaggcaggagaatcaggcagggaggttgcagtgagccgagatggcagcagtacagtccagcttcggcttggcatcagagggagaccgtggaaagagagggagagggagaccgtggggagaggggagagggagagggagaccgtggaaagaggggagagggagagggagagggagaccgtggaaagaggggagagggagaggggagctttttttttttctttctttggttggctgattttgagacagagtctcctctgtcgccgaggctggagtgctgtggtgcaatcacaactcactgcagcctcaacctccactcagcaatcctcccgcttcagcctcccaagtagctgggatcacaggcacatgccaccatgcccagccaagggtttcaccatgttacctaggctgatcttgaattcctgggctcaagtgttagactcacttcggcctcccaaagtgttgggattacaggcgtgagccactgcacccagcctgttttgtttggggcaagggttttaacatttatatatatataaatatatatatattttatatatacaaatatatatataaatatatatttatatatatttatatataatatattatatataaatatatttatatataatatattatatataaatatattatatataaaatattatatataaatatatatatttatatatataaatatatataaatatatatatatataaaaataccagcacatcagtatcaggaataaatgggctgggcagtatatatatatatatatatgtatatatatatactgtttttcatatatatatactgtcttatatatatatatactgttttacatatatatactgtttcatatatataatgttttatatatatactgttatatatattatatgtactgttatatattttttatatatatactgttatatatattttttatatatactgttatatattatatatatactgttatatatatattttacatatatactgttatatatatattttatatatatatactgttatatatatatattttatatatgtatactgttatatatttatattttttatatgtatactgttatatatatattatatgtatactgttatatatatattttatatgtatactgttatatatatatatttcatatatatatactgttatatatattttatatatatatactgtcatatatatattttatatatatactgtcatatatatattttatatatatatactgtcatatatatattttatatatatatatactgtcatatatatattttatatatatatactgtcatatatattttatatatatactgtcatatatatattttatatatatactgtcatatatatattttatatatatactgtcatatatatattttatatatatactgtcatatatatattttatatatatatactgtcatatatatattttatatatatatactgtcatatatatattttatatatatactgtcatatgtatattttatatatatactgtcatatgtatattttatatatatactgttatatgtatattttatatatatatactgttatatatatatttttatatatatactgttatatatatttttttatatatatactgttatatatatttttatatatatactgttatatatatattttatatatatactgttatatatatattttatatatactgttatatagatactgttatatatatactgatatatatactgttatatatatactgatatatatatactgttatatatatactgttatatatatatactgttacatatacatatatatactgttatatatatactgttatatatattgttatatatatacacatatatatatacatatatatatacatatatatatacatatatatatacatatatatatacacgtatatatatacatatatatatacacatatatatatatacacacacatatatatatatatatatactggctgtgtgtggtggtgcacacctgtaatcccagcactttgggaggccaaggcaggctgatggcttgagctcaggagttcaagaccagctaagcaacatactgagatcccatctctaaaaaaaatacaaaaaggccaggcacagtggctcacacctgtaatcccagcactttgggaggctgaggtgggcagatcacgaggtcagcagttcgagaccagcctggccagcatggtgaaaccccatctctactaaaaatacaaaacattagccggacatggtggcacacacctgtaattccagctactcaggaagctgaggcaggagaatagcttgaacccaggaggcgaaagtttcagtcagccaaaatcacaccactgcactccagcctgggcaacagagcaagactctgtctccaaaaaaaaaaaaaaaaaaaaaaagccgggcattgtggtgcctatacctgtatttgcagctacttgggaggctgaggtgggaggattgcttgagcccgggaggttcagattgcagtgagccaagactgcaccgctgcactccagtctgggtgacagagtgaaaccctgtctcaaaaaagaaaaaatactgtccctgccaaatccaagacagacagcttttctttttcttttcttttcttttttttttttctttgagagagagtctcgctctgtcgcccaggctggagtgcagtggtgtgacctcagctcactgcaacctctacctccctggttcaagtgattctcatgcctcagcctcccgagtagctgggattacagccagttgccaccatgcccaactaatttttgtatttttagtagagacggggtttcaccatgttggccaggctggtctcaaactcctggcctcaagcgatctgcctgcctcggcctcccaaagtgctgggattacaggcgtgagccaccgtgcctgggtcagacagcttttctatagtgaaacaaatcacacaggaatataattatgaccattttccctggcaaatatctaagtaactttaaggtttgtcgggtcctgtgtcataggtgttgccatgtgtgctacctttttcagaaggccccatttaccttgtaaacctctcttcatctctaataggccctgtatgggctctgctgtctcagttttaactgtcttctgcttgatgtgagttcagcctggggatataaagctttgcagagccaatgcctttgcattattccctgaaagcttgactagggaggccaatcattatgggccagggtgggattccttgaactctcttggaatgggctcaccaaggactatctttggttctaggaaaacctatcattttctttcctttaaattaagcgttttcagtggcattggctcagccaagcatccctagcatttctacttctcaaccataggtgagtggtgctcccatgagttgtgcagtacacaacctgcacagccatatgtggcagttgtgcaggggtggcagttctgcctaccctcagtggaagatggatggagatttgttctaaggtaaacctgggatgcattcctcacatatgcaagaaagctgagtgagtgtaaaattagaagtccatagatggagagaggcagagaaacaggacggggagtctcaatggaattccagttcctggtgttgtcttgcaagtctgacttgatctctgccctccccctcatttgattatgtaagctttccaatcaatattactctttatttatttctttttagcataagttaggtttctgtcaccaacacattctggctaaaagcctgagtcttttccttatcttgccccaaatggccagttattgtggaattccactgggttttggctgttggatgaggcactgcgggtattttgcttatccaggttgactttcccatctgtgacactggcctacctaatgagggattccagcaaacaggatggcatgctgagctctcaaaataaacatgtatggcagcctttgcacacagtattcagaaaacaatccattatcagtggcttgccgttattttttggtccctaaatgtattttctggcattaaaaataaaacagcaggtatgctccctccaagaaggagaagtgtgtgtgtaaattgggccttttctactggagggggtgttctggggtacaagtgagggcccagtgagggctcaggctgacaatcaggactacttggaaaatagtgttctcaagagtggaggaagtgggctcaaaggagcttgaggagactatagggggaagcgcaggacaccagccaaggcagtcctggagtgtgcaaggcccaggaccaagatttttggcgtggcccctgtctctttctgttctagtccaggaaccatctcttcatcttttttctgtttgtttatttaatgtaaaatgtgccattcctgcttactcttatattctcatcacaaaaaatggtacattgtttggaacctgttactattgaagatcttgcttttgcagttccctaatacatttatttaatgctggatatatcattatgtacgatgctatatcatctatgggtggctgacttgttctcaaagatagttactgtgccttactgatgagaactacaaatataaatgttgccaagagtatgcaggaaaatgtgcatgataatttattttctggtcatgttaaatttaccactgggaatttttttcttcaatgtaggacaacgcctcttacaactgtatcttgacctcttgaggcccaaatcgctgcattcctataatgtggttgctttcaatgatgactgcacccctgccttccacatgccaccattagcagggagcacagcaagaggcctgtgagcagagtgagaagagcaagctcatttaagcaggatacttccatctcttattctccatggcttaaaaccggtgagagaataatgtctcaactggaggtgtgaaagtacatcaataggaggtgtatgttggtgttggggagcaacatctcaaaaatccttggtggatgttatggactgaatatgtgttccccccacctcccggccccaaattcatatgccgaagccctaacctccaatgtgatggtattaggaggtggagctttgggaggtaattaggtttagataaggtcgtgagggtggaacccccatgataggtttgtttgtttgtttgtttgtttgtttatttatttgagatggagtcttgctacctctatcgcccaggctggagtgtagtggcacaatctccgctcactgcaacctccgcctcccaggttcaagcgattctcctgtctcagcctcccgagtagctgggattacaggcatgcgcccccatgcctggctaatttttgttttgtttttttgttttttgagacagagtctcgctctgtcgcccaggctggagtgcagtagcgcgatctcggctcactgcaagctccgcctcctgggttcacgtcattctcctgccccagcctcccgagtagcttggactacaggcatccaccaccacgcccagctaatttttttgtattttttaatagagatggggtttcactgtgtcagccaggatggtctccatctcctgatctcgtcatccgcccgcctcggcctcccaaagtgctgggattacaagtgtgagccaccgctcccggcctaatttttgtatttttaatagagacagggttttgcctgttggccaggctggtctcggactcctgacctcaaatgatctgcccgcctgggcctcccaaagtactgggattacaggcgtgagccactgtgcccagccgggtttaatgcctttataaaaagcagaagagacaccaaagcttcctctctccaacatgtgaggacatagcaagaaggcaagtggggaagagggccctcaccaggaaccaaataggccagcaccttgatcttggacctcccagcctccagagctgtgggaaataaacatctgttgtttagactgtggtacccaggctgtagtattttgttatagcaacctgagcagactaagacagaggacataggcatggccaatcctggaggacagactgacagctgatccggagtctgccaaagtggtgaggtgactgccctggagtcagctggggaaggggtgcacaggtaaaggatgcctgccacacgtatccccctccccaagatcaccctggctgcaataagccagaggtggtactctggtctgaagacagaggtataagccaaggcatatatccactcaggcagctcaagcacaagcatttgcagagcccagatccttgaactcgtgctgtgtccaagtgagtgaaagcatgtcagcagcatttctgacagcctaatctcatataatctagtgaaagaaattctacaccaggcagcaggagtgagctgcttgcaaggctgctctcagaaccagatctggccatgacgactccataaacatgaattctggagcttctcagggcatctggttgaccctacatatgtgtgagagatgggtaggggtaagagagagggttggagagcaccctgaagaggagaaacagcaaatgggacccacagggaaaggacttggtctggagctcggttgccctacctagatggcaccactcaccctagctagtcccagccactggagagagacttagaaaatttcaaggtagaaaattgtggtcaacaagagtcacatgggatctggtctagacagagacacccttcctaaatggcattgctagccccagaagggcacttacaaacttttgaggaatacagtccaaagtgcaggaccctcttaaggcacagagtctggcacaaggggcctcacttgcctgaatctaatggtgttactaccatcaaccactggatactatccactaagaattaacagtaggagcaagaaggtgggttcagcactgagccaatgaagtttctatccgtcccctcatccatccatccatccatccatccatccatccatccatccatccaacacatgttcattgagcacttaacaccatgccagtattgttttaggttcaggaaaacagcaatgggtctgaccaactatttctaccccaagctggtactgcacaattaaaaaagaaggaaaaataaaacaagaaaaaaatggccacagacgtatctcacatacagctgttcatttacaaacttttctcaattatggttcttgaaaagtgttccaattactgcgactgtatacaatttaacccaaaacttagtggttggggtaaatgacaatgtttattttactcatgaatctgctatatggactgctcaatatttttcatggatccacatctcttatgggctgctctcaatagggttagtttgtccctgctcagcttggtgtcaggttggggtggaggcttgaagcctgggggctggaatcatctgaaggcttcctcactcatatgtctggctattgatgctgactgtcaccagaaacttagctagggctggtagctggaacacctcttcatgttttccttatgtggcttgggcttcctcccaacatggtggctggggtcccagagtgagcattgtgatagggagcaagccaggtagaagctgtgtcttctttatgacctagccccagaaatcacatagcatcacttttgccctattggttagaatggtcacagacgcagccagactcaaggagaaggaacatcaatcccacttctcagtgggaggagtgtcggttacatcataaggagaaccatgggatggatcatatagattggtatggcatctcccagaatgatgctttcagggtaaataaaacaaaaaagactggtgtagtgatctttggaaaaaagtctgtcacaaaagcttataccgctgctcctcttttttccaattctgtgcctttccaaacacactatacacaatgatattttgacattacagttcagatgaagacattccccagtttagtcgatgtttctagttagagatcatgccgtggaacaaatttgaattgtgcactatgtttggagatccaaaatgttttactatgtgtagcatctcatgtgtctcttaagtttattgtacatgtgtgcttttctcaaatgtttcaaagtgttctaatgtttagtctttaattttccctcaaggtatatgtgcgtatgtgtgttttatttttatgtttgtttaagtgaagacttcaaaagttttaaaaaattagcaaagagtgcagaaaaaacatatcttttatgccaggcacagtgatgtgtgcctttagttccagctacttgggaggctgaggcaggtggatcgcttgggcctgggagtttgaagccagcctgggcaacatagcgaggccctgtgtcttaaaaaaacaaaccatcatttagagaaccactcacttgcatctctcctccaccaacttgcacctaatattaaatcttgtctttctgtccagagcagtaagtcttactgccttacatgttatgtaaaaaccatattttaagcaaaattatttgtttgtataattttctgttgcatcaatatattttttctgttaaaaatatttaggtgccttaggctggaattgaacacaattttgcccattttaattaatgggaaaaatttaacagctttccacttagaagcagaatttcaggaatgaattgaaaccactagaagggtgatagctgtattttcatcatctccccaagggctttgggacagctttcccatcctctgtgcctgtcacttttccaattcccatcacccgttgttcttccagttagtcacccctcccttgtctgttacaggggttcagtattaattgtgttagaatgcatctggttgcaagtaacataaaactcaacaaactctggtatatataagatccctcatcccgataagacaggaaggtagtacagggtttgtgtagctgcttgagtatgacttaaacaaacaggctcctgtctttctgctccaccttcctcagcacagccctcctcatggcctctaggctgctgtgctcccaggtgttacccagttccaagcatgaagcaggggaaaagtgaaggacacaaacttctccaagggaagaaggaagggaaggtctcctttgatacttctgcctacatctcagtggccaggactttgtctcactgccacccttagcagcaaagaaagttgagagttgtgtgctttgcttttcagcccctgtagtatagaaaggcaagggagtggttgaaatagatcttgagttagccaactacataatttgtcacactgtgtttaattgaaatgtattgcttggatccagtgtcctggacatagcctcgttcctgtcctagcacattcttaccctccttttccctcttccttcctgtagctatttttctggggggtgaggtgtggtcttgaggaaacactcttcagttttaccctttctgtgaggatactagttcccttatcactcattcctccatagtctcttctaactgaggtgaggagtcagaatcttctttgctcccttctgcttttcagacaaccgtgccttcacctctactcaacaccctgacccctcctccctctctcaatacccaaggtcagtctcaaggccaggtcctccgtgaagaattccaccatccctccctcctcttctttctcagtccaagtttcctcctttagattctcaaagcacttaagctgtacctctccaatggtattattttcttcgttgaagtgaaagcaaattattgaaagtggtactgtttacaaaatgtctagcgcatggcaggtgctcgaagtagtatctcttagtattattactactgtcttatctcgatcagattcagctctttaatgagaggctctaaatcttatgttcgattcacctttgtaacccacaccgggcctggaatagagcactgttcataattaatgctgtgcccgtgtaataagacggcggcgagcaaagggcatcatttcagaggaagagtgctgtaatggtgggatgggagaaattcctagaacctaggtgggagccagaatcttgcagagaagccccttatccgtctgcaccgaaagcaggtagagtggatgccgtaagattcctaaggacgcaggtagagcgcctcctctgtgccgcgatgaggtaggtgcatccgtcacttcactcctccctctccacttgatccggaatgggaggaacgcaatgcgtcccgcgcggcgatctgggatagctgcgcaggcgcagcttccggctctgtgtctcgggaattatttgacgccaccggttcagccccgtagaaagctctgattaggcgcaccgcgcacgcgcagtggcccacttggctggggagttatttgacgccgccgcccctggcagtcggaagttgcctgagcagatcccagccggctggctcgagtggccttcgtcgtcccttggcgccctgggagagtcgctgacgggtggactgacggaccgcctgaggacggccggccagggcggtgaaagcgccagccctatggcgcgggtcgcgtgaggcggaaggccgaggacggccggcggcggcgcccgccccggcgatgcgggccccgcccgtcgcctcaggtaaccgggcagccggccccgccgcggccggaccctcccctctccttccctctcttccccacctggcggtcaagggacggctgaggcttgtttctcggctctgggtgctccaggggcccggcctttggaagctcatctgcaaatttttgggagacccacgggggcggggaaagcttggccctggagtgggcggctgctgtcgagtctgtgtaaacccggtctaatccttgggagctaccccggccaggcgaagctctctcctggcaacctgggggagggggcgggtctggagcggagctagacaactcccgcaaagaatttggtccagcagaaaggttaggcaagttgctgccgcccagtggggacgatgctgcccattgcacagtgacactttgatgagggagagttgatgatgggagtaaacagctaacccccattaagcgcttcttatccgccaggcatcatgccaggccattacgttctccacgtctaacttcacagcaaccctgtgaggtaggattgttgtccccattttactgacgaggcaactgagtccctgggtggttgggtgacttaattacccaaggtcacatagctagtaatttgaaccggagcatccgacccaagtgcttaacaattagggcagtggctctccaactttgctacactgtagaatcacctgggggaaattgtaaaggtttctgatgcccatgtggcatcccagaccaaaacaatcagaatgtctggagttgaaagccagacttcaatattttttttttaaagatgcccaagtgattccagcttgcagcaaagtttgggaaccgcatgtaatttgataattctgcatctcaaaaagcatctctctttctccagcttaagtgtgcaggagaattgtctgggagcttgttaaacttgcaggttccacccgcagagatctttaggttgactgaccactacaccttgtgaaagactgttagggatggaattctctgcagggattctgagtcatctggaacatttaaaatgtatgcatcttatgcaaactgctcgtttgcaattttcctaaatatacagtacttataggtgtagcgtctgtaacctctgggtcgtttttacatatgctggaagtctgcctagaccatcctctgaacgttctggccatcccacccaaacgcacacacttctgctctctcctatatgcatatacacacccttttcttttctttctttcttttttttagacagagtcttgctctgttgcccaggctggaatgcagtggcatgatcttggctcactgcaacttccgcctcctgagctcaagcagtcctcccacctcagcctctcaagtagctgggactaccacgcttggctaatttttgaattttttttgtagagatggggtttctccatgttgcccaggctggtctcaaactcctgggctgaagcagtccacccactatggtctgccatagtggtgggattacagatgcgagccactgtgccaggcctacatacccttttcttcctgtctctggctgcattagctttaagcattcccttcaagatacctctgtccctgacccctacccaccttgagtccttccaatttgctctttaggaacatcgtagtgaaacttatcagttatttttctgagttgtagttctatccctacttctagattatgagaagctttagggcagggactatgttttcttcatctctgtattccttccagtgctttgacatacagactcacaaagcttttactcagtggaatgtttgggtccttttatgtcatagatagatcatgttgcgaacagattcttctctatttccatttttgtaaaagatgtttggtagttcccagcttatagagttttgttctttttgcttaggagtgagtattctagttatgttcagcaatttgtccagcagttgaacacacacattgagttcttaccaattgcaaggcactctgtaactaaccatgtgcaatcaacattgtttgatttttaatgtctgattctatcacaatcggacgcaatcatgtctgtagggaaagtctttttattactgttagacctttgcatgtgttccctacttcattgtccaaaaaagtgtttagttgtcatccactaaatgccactgccttgttggtatttggtaaatacaagcagatgggattgccattggtaatgtttggtcctgttcaccaggagagaggacgttaagtacttaatgaagagtaaaatcatgttgtcacaggaattgacaaatttagcacatatttattgcagaatgcctgaactgccattgccccatttgccatatttacaagtttaaaggaaggcagaccaataattcagattggatttgttcttggttggtcttaaaaccatgtaaggatttgcaaaagttagtgaatatgtgtgtgaaggtcattatgaggaggtttttggacaataaagatttttttttgtatagcaattaaacatgacaaagtatgtagactgaattaaaaacacatttcataaaattttttttttcttttttttttttttgagatgcagtctcgctctgtcccccaggctggagtgtagtggcgcaatctcagctcactacaacctccgcctcctgggttcaaacgattctcctgcctcagcctcctgagtagctgggactacaggcacccaccaccacacctggctaatttttttgtatttttagttgagagggggtttcgccatgttggccaggttcatgtcgaactgctgaccttaagtgatctgcctgcctagtcctcccaaagtgctgggattacaggcattagccaccgtccccagcccataaaatattctttataaggattgttatagaaaaattttcttggttccgttttgtattatttggtcagtttttaggcttagcactaatagaaactgatgggacaacttatgttaaattcagatactcaagaaacttgtccttgtgtgtctgatcagatagggacacagtatccagttcttgctttagcacatggaagaaactcaatctttaaggctgaaggtttaagtctgtagttgtgccccaaagtaaaggtgaaaaattccacatgctcagagaacaaaagtgactctaatcatgatagcttgggacctagaaatggattctgtttaatacgaggtactcatcagtgttagcaggtgtgtttcctgacatgtgcaaagactttttgggcagaatagttgattttctttggtgcgagatgatttaagttttaaaattaaggtgcatggagtttcattctaactttttatagatgcggaaagtaacttggtcaaggctacatggttagcttctagcacctccaggactagaaagcaggcctccttcctctggacggtgtcccctttcgcccccgaccccttccccatgagaaaggttgtcttgtgtattgttgtgttgtgtttgcctgtctgtgtgtgcatgggatagggaaggggagagagtgatctgctatgtttgagaaactcaattagatatctagaggcccctcgacttatgatgggattacttcccaataaacctatcaaagttgagaagatcgtaagccaaaaatgcatttaatatacctactgaacagaatagcttagcctcatctaccttaaacatgctcagaacatttacattagcgtacagttgagcaaaattgtctagcacaaagcctattttataataaagtgttgaatatttcatgtaattgattgaatattgtactgaaagtgaaaaacaatggttatgtggataatcagagtacggtttttactgaacgcatatcactttcacaccctggtacagttgaaaataataagttgaggatagtgagtacttggtgtgtgaaatgcacttagctatataaactgggaatacaaagataaataagacacggcccctgtcctcaaggagtctaatcaaagttataataaaataatagtgtagtatctgaagcagctctgtcaaatagaattttctgcaatcatggaactaaatcttacttgctctaatatggtagccactggccacatgtgacttgtaagcatttaaaatgactagtgtaaccaaggaagtgatgtttgactcaaatagtttaaacttaaaactattaaaattaaaagtttttaaaatttaaatagttacatgaaatagctgctgtattggacagaggtctgttttatgcctcagagaaggtctcaggcataaaagatgagaactgtggtggtgctggtagggggcagacagggtattcaaacgttctttgggtagcttaccaaaaactaccattttccatgttttgggagagatgcaggcagaacctgtctttgtttcctgtaattcaggtgtttgataggatctctaatagcatctggtacataggtgaataccttccttttttgccagctttattgatgtttgccttatggggtcaatgggactgcaacagcaatatgaatcatgaggttatatggatgaatttggtgcaccttaaaaaaagcacagtttatttatttgctcagtgttttagcaccctgtatcctatttttcccaagagaaataggcatgtcttataatgtgtaccttccattggtacatttcaaagtatgtcaacttaggttgctttatttgatccttctcccaggtcactctagataggcactgcaggtattctccctgttttacagatgaggaaactatgacaaagaaatgccaggtcaccgagtgcggtggctgacttgtaaacctaacactttgggaggccgaggtgggaggattgcttgagcccaggagtttgaggccagcctgggcagcataatgagactttgtctctataaaaatttttctaaaaattagcggcgcatggtgacacacacctgtggtctgttacttgggaggctgagtgggaggattacttaagcctgggaggcagaggctgctgtgagccgagatcgtgccactgcactgtagcctgggcgacagagtgagaccttgtctcaaaaagagaaatgccagttgacttatccaaagtcatatggtgaggtatggagtcaggacaaagggaagtagcattgcactttgaggcaagaggtggagtttcttgtcccagatccgctgttacttgatgtgatcctgagcaagtcatagctttactttgtttccttacctagtggttagtgacgtctgtcttacctaaccttctagggttgttattggaataaaatgaagtaacatgtaaaagctctttgaaaatgataaattatgcaaaggtacaatgtgctcaagcaagacctcaagtagtttttctttttttttgagacggagtctcgctctgtcacccaggctagagtgcagtggcgtgatctcagctcactgcaaccttcgcctcccaggttcaagctattctcctgcctctgcctcctgagtagctgggattacaggcagccgccaccacacccggctaatttttttatttttattattatttattttattttattttttatttttgagacagagtttcgctcttgttgttcaggctggagtgcagtgacgccacctcggctcaccgcagcctccacctcctgggttcaagtgattctcctccctcagcctcctgagtagctgggattacagacatgcgccaccacgcccagctaattttgtatttttagtagagacggggtttctacatgttggtcaggctggtctcgaactcccgacctcaggtgatctgcctacctcggcctcccaaagtcctgggattacaggcatgagccactgcacccggccaatttttgtatttttagtagagatgaggctttgccatattggccaggttggtctcaaactcctgacctcaagtgatccacccgcctcggcctcccaaagtgctggggttacaggtgtgagccaccacatccagcctcaagtagtttgttttgttgtattatgctgctgtcgtaactcatcagttaccatattgaatactactgtaccatggtgtcatctttgatttctcttgtcttcctcactatgaaactttctcttgggcagccattgtgttttgtttatattaggatttgtcctaaatcctaggacaaatttgacatgtagctggtgtttaatgtttgtttaatgaaataactgatgtctggatgtactttacaaagttttaaagaattgttttttgtaatgagacttgaagctccttgggaacagggatgttgtttattttctgtgcttgttgcatagaaggcatgtaataaatattgtttgaatcaattgatgtaattaatgtcaggctatggtcttagagtgtccaccattgtattgattattttggtaatttgtcatttagaccaaacttgcatgttattttgcggtggtgcttacaagccataagctgttacccagcacacacaacctccagagagaatacctagaaaatgagtacatatagagttgggaaggaaattaagggatctgcaggggagcactgttgacttcttccccttcttcccattatatttacttctggagcattgaaggtagaggtttctctgctagcagctcaggttgatagcagacagccacctggggaggggactcaggatccctaatatagcagttgaagtccttaatcatctaacttgacagttatatcattatatctcactacagtgcctgaaacctccctgttacccccctgaccgccctcaaccttagcctatatggtagccacattggagtttgctcttctactatcccttcagtgtatcttggacacttccatcaaattgctttaatggaaatttagttcccgatgtgtcatgcctgtggtaaggttaaactttcttcttttttttttttgtttgagacagggtcttcttctgttgctcaggctggagtgcagtggtgcgattttggctcactgcatcctccacctcctgggttcaaacgattatcatgcctcaggttcccgaatagctgggattacaggtgtgtgccaccatgcccggctaagataaggttaaacttttgctcattttctgcctccagttttactgaattaattacaaatattcaatcctaacattcagagtccttcaaaattggtcactgcttacctttgaaaccttaccaccttctacatatagctttctttcctttggctctgggttttcggtttctagtgctttttttttttttgctacctgaagcaagtttcctttcttttatgtattttcttttctttctttctttttttttttttttttttgagatggagtctcgctctgtcacccaggctgtagtgcagtggcgtgatcttggctcattgcaacctccgcctcctgggttcaagcgattcctctgcttcagcctcctgagtagctgggattacaggcgcacgccaccatgccctgctagtttttgtatttttagtagagatggggtttcaccatgttggtcagcctggtcttgaactcctgacctcaggtgatttcacctgcgtcggcctcccaaagtgctgggattacaggcatgagccaccacacttggctcttctatgtattttgttctctcttttatctgtgactcccccacccccgccccccccttttttttttttgagacggagtctcgctctgtcacccaggctggagtgcagtggcgcaatcttggctcactgcaagctccgcctcccaggttcacaccgttctcctgcctcagcctcctgagtagctgggactacaggcgtgtgccaccacgcccggctaatttttttttgtatttttagtagagacggggtttcaccgtgttaggatggtcttgatctcctgacctcgtgatctgcccatcttggcctcccaaagtgctgggattacaggcgtgacccactgtacccggcctcatctgcccctttttaccctcagtcttatcacctcaattttcttacctccatcaaaattatacccttccttcaatgcacaattcgtatgctctgtatctgtagtctttcctgatcttaccctgttgttttccagctcagcctatctttcaatcaaaagtaatctttttcctttgaacttccgtggtgtcttgcctatagtttttaaaaatatcacattcaacattttaatgttctaacttatgttatagttatttatggtaggtattagtctgttttcatgctgctgataaagacatacccaagactgagcagtttacaaaagaaagaggtttaatggagaaatcctagttccacgtggctggggaagcctcacaatcatggcagaaggcaaggaagagcaagacacatcttatgtggatgacggcaggccaagagagaacttgtgcaggcaaactccggtttttaaaaagccatcagatctcgtgagattcattcgctgtcatgagaacagcgcagtgaagacttgcccccataattcagtcacctcccacagggttcctcccatgacatatgggaattgtgggagttacaattcaagatgagatttgagtggggacacagagccaaaccatatcaatgtatacatcttaatctccttaattaagccataaactcattgaaaacaggaaccaagtcctattaatctttcttcttcatggttttaacactgcattggacaaaatagatggttaatagctgtttattgaataagtctacttggtggtccccgccagtgtctctgaatgttcatatgtatagtcaggatgctgacatatacttaccaattctatgacataaagatgtagtaataaaaacatattacattaagttgtaccaacatttctaccactaagttaaaactacagttgactctcgtacatcataagggttaggagcactgaccctgtgcaatcaaaaattttcaagtaacttttgactctgccaaaactagtaatagtcttctgttgaccaggagcctggccaataacataaacagtcaaataatacatattttgtatatatattatatgctatattcttaaagtaagagaaaagaaaatgttattaagaattagaaggaagagaaaatgtatttactattcattaagtggtagtggatcataaaggtcttcatcctcatcatctgcatgttgagtaggctgaggagtaaggggaggcattagttttgctgtctcagggatggcagaaatggaagaaaatccatatgtaagtggaccttagcagttgaaacccatgttgttcaagggtcaactgtacttgcatttctctaccatccttctaatctttagtcacagctgtatgtttatctttttttttttttttttttgagacagagtcttgctgtgttgcccaggctggagtgcagtggcgccatctcggctcactgaaacctcaccctcccaggttcaagagattctactgcctcagcctcccaagtagctgggattacaggcacacaccactaagcccagctaatttttgtattttttagtaaagacagggtttcaccatgttggtcaggccggtctcgaactcctgacctcaggtgatccacccaccttggcttcccaaagtcctgggattacaggcgtgagccaccgcgtctggtgtatgtgtttatctggttgtaattatgatatatatgtttttctttctctaatagttatttattgattgcttacatggacaagggcatgtttcaaacggattacatatgtgattctttaatcaccaccacaagaaacacaatgtgtaggctcctaatctactatttgcttttttttagacagagtcccgctctgtagcccaggctggagtgagtgaagtggcacaatcatggctcactgtagccccaacaccaggatccaagtgatcctcccacttcagccttcagagtagctgggactacaggtgtgtgccaccacgcctggctaacttttttgtgttttttgtagagttgggttttctccatgttgcctaggctagtctcaaagtcttggactcaagcaatgtgcccgcctccgcctcccatggtgctgggattataggcgtgagccaccatacctggccttattctattattatccccattttacagatgaggatgttccaacacaaaagtagagtaacttttgcaacgttacccagcttgcaggtagagctgggatttgaatctatgaagcctagttccagagcactggctcttaaccactctcatctatgtttttatgcttctctgtaatctcagtgtttaatggctacataatagtatatagaattaatatgtcctaattatgaaattttcccattattgatggaagttaaattacacccacttccccatcttatatgtaatactacagtgagcatcttgtacatttttaaaaattgagctgttttataaggataaacaagtcaaattaccgggtcaaggcaccctttgtcttctgctttgtactggcaaaacgttcatgctatccttgggtgaatgtttaggaaatgacatatcagcctgaggtgccttacaagtgtgccaacttactaacgggatggagctacaaacaaccccatggcaagtagactaagacatggcaagtgtgatcaagacatgtgagggttctgccatggtgctatcctgagaggttgattcttgcctaggagggcctaggtggtgcagcagtactggctcctgaaagtaacgttctccaggatctccaaggtttgttgctttggatagcctaagccgcaacagcaagaggaggttcttatttgtgtgtttaagagtaggctgggcaggcgcagtggctcatgcctgtaatcccagcactttgggaggccgaggtgggtggatcacaaggtcaggagttcgagaccagcctggccaatatggtgaatactaaaaatacaaaaattagccaggtgtggtggtgggcgcctgtagtcccagctactcaggagtctgaggcaggagaattgcttgaacccaggaggcgaggtcacagtgagccaagatggcgctattgcactccagcctgggtgacagagtgagactccatctcaaaaaaaagaaaagaaaagagtagactggccactgacaatactgggcctaatggaactccctctaccaaatctgtcactgcactttgccttcatcccttttttccctaacagcaaccacgatgaaataaagtgaagttgtaggacctccatagttgggttataagcccagccccagcaacaaaggtgggttggggtgacttctggggcaccaacagcttatacaaagtatacacttcactatcctctttccacaaggattttgctataattcagttaccaaaactagtatatgcctttatctgtgatcagaggcataaattggaccatagataagttcttttttagctgacattgtgtttttttgtttttgtttttgttttattttgttttgagtttagttgataacatttaaagagtaggagactgtagaaatgtccagattttctgtgtctcttcaaaaattggattatctggcaagtctaggtctgcattccttctaggtgacagctagaactgtgtaatagctgtaaacagagcttgtatactagctcttgttgcccaggctggagtgcaatggcgcgatctcggctcacagcaacctctgtcttccaggttcaggtgatcctcctgcctcagcctcctgagtagctgggattacaggcatgcaccaccatgcctggctaattttgtatttttagtagagttggggtttttccatgttggtcaggctagtctccaactcccaacctcaggtgatccacccgccttggactcccaaagtgctgggattacaggtgtgagccaccaccacacctgcctggtgatgtgatttttctagagttgtgaacagttcttggttctaaagataatgaagcttagtcttcctcaatttatatgattaattgcattattggaaaattcagtctattaaaatagcacaatatattttgtatttatatgtaaatgaagttaatttttaggctcagacaatggttttctagcagatgttcaaaagtcatgtgagatgtggcataattgttcattgtgcaggactgtctcatgcagtacaggatgtctagatttcctgactctgcctgtaataccagcagcttgccctactcattgtgctaaccaaaagtacacttatttccacagtgcctctaggtgacaggtttttctattaaaaatcattgccctaatctctcagttgggtccttacctcctcatcagagttgagttttttgtttttttgttttttctttttttgagatggagtcttgctcttgtcacccaggctggagtgcagtggtgcgatctcagcttactgcaacctctgccgcctgggttcaagcctctcctgcctcagcctcctgagtagttgggaattacaggtgcccgccaccacacccggctaatttttgtacttttagtagagacggggttttgccctgttggccatgctggtctcaaactcctgacctcaggtgatctgcccgcctcggcctcccaaagtactgggattacaggtgtgagccagagttgagttttatcgcttgttttgttagtttaataggtacaaaatgatactttagttgcctttgtgttttttccatgtttgtttctaatgtttatgttctcttcattgttttacttaatatatccgtaattataatgcatttctttgttttaatgttttttgtctgcattttgttaaagtttagcatcttttttctgttacatatattttgatgttttagttcagctttttcattgtatcctttctatatcttttttttttttttttttttgagatggagttttgcttttgtcgcccaggctggggtgcaatggcaccatctctgctcactgcagcctccacctcccggtttcacgtgattttcctgcctcagcctcccaggtagctggagttacaggtgtgtgacaccatgcccagctaatttttgtatttttagtagagacagggtttcaccatgatgttgtccaggctggtctcgaactcctgacctcaggtgatccacccacctcagtctcccaaagtgctgggattacaggtatgagtcaccacgcctggcctatatctttctattttacatgtttcttgaaagcattttttggtttcatttaatcatttaaacattaatacatttagagaatgaaaatttcttacatttaaaaacttaaaaaaagtttgtcagaaggatttaatagctattaaacctattttgattggtctttcataaggtatactcctctcttcagaattgggagggtagtggccatttcttaaaaatgcagattctcaggccccagctcagacctgcagaattgagctttttctgaatggggtctaggagtctgcattttcagctagaccctttcctcccctgatgattcttaagtgtacagtagagtttgagagctagtttgtccttttttttcttcttaaaatctgttttcttccaataatatgctgtgatggatcctgaatattaaatattcatttagtatttggaaaccatccaacttttatttttactagtaattagcttcaaacaagtgaacatttttaaatttttatttgaatataacatacaaaattttggacacactttagtggaatagagggaataccttctgatatcttcctttttcccactggtaaaccttgacactctcaaacacatggtcaatgtccactgtgtgctagggactcagaggttcaggaggcaaggtccccacccaaaaaaggctgacacttttgtggtgaatgtatccgtacaccactaatgaatgagctaatggcagctttatatgaacatccggtaataggcactcagctgagaggagttggtctaaggagtcaagaaaggttttaccaaagagaggacatttgagttgggctttgaaggctgagtacttcataagatggatcaaggcagggaatggcagttcagtcagtgggagcagcatgaccagtgacttagggtaagaaaggatttgctgggcttgagcaatcatcagtagttctttgtggccattgcttgggatgtttgtgggaaagtggcagtagaagatgaggctggcaaggtagtgtatgcaattcccattagaattgtagcaaggctttattgttgatttttttttatttggataaaataataaatcgtatactgaagaataaatgtctagagaagacaataaagttttggaaaaaacattctataaagccactgaacttaaatcattatgggttggcatgggaatagacaagtagttgagtagaacagaagtttcatagattctagaagaaatgaaaatttaatatatgacagaattagtatttcagtttagtgcgaaaaggatgtatttttaagaggtgatgctgacacaactgaccatacatttagaagaaagtaaaatcagacctttcctacaccacttacagaagtaaattccagatgaatatacaagttaagtgaaaaattatgcaattatcttgcaggaaaatctaggagactacatattcacattagggttatgttttcaaatttttggactaagacctatcataacaaatgtattttccgctgggcacggtggctcacacctgtaatcccagcactttgggaggctgaggcgggtggatcacctgaggtcgggagttcgagaccagcctgaccaatgtagagaaaccctgcctctactaaaaatacaaaattagtcgggcatggtggtgcatgcctgtaatcccagctactcaggacgctgaggcaggagaattgcttgaatcgcggaggttgctgtgagccaagatcacaccattgtactccagcctgggcaacaagagcaaaacttcgtctcaaaaaagaaaaaaaatgtattttccattgtgacccagaacatatgcatatattacaaaggaaacaagtttcacagaaacattgcttgcctttattatgtgtgatgcctttatcatacatcctataccatctaattaaaacaagtattatccataacatttatttcatgacccatagtttgaaaaacattgatagtttcatgacccacagtttgaaaaacattgatagaggcaagatgtttgcagcattctttatcatgccaatagtctatacatctgttttatttatttctgttaatttccaatagtataatttgacatgcatttctgttttgtcttttcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaagtgtttctaaatttcattctcttatatgaaaatgtacatttgttcttgaagaatttgtttaatgttaacttttttgttcttttttctttgaaaagagctgtagtagaataacgtcaactttttaatggatttctccccaacgtagtatgacttctcaattttgatcttgtttgagttgagggctgggactcggagtttgtggaggttataaggagtgagttgtactgttttgctgctgggactttttactagttatggtcaattctccacttgagctgaaggccaagacaaagacttgaatgtcaaacacttcccccaaagatctaggcttagtcttctgatttccatttagagtgtgtttggaaggcctcatccctacctctggatggcccctgactgaagactcatgtcaagttttcaggctatgtgtatgctgtgcttaagctctcccctgtccccatccctacctactccttcctggcttccaggtttaagagtgctgcagagaagccaagcccttctggcctaagcctaggtgattggaattggggttgtgtttgctgtttctttttttttgacagagttttgctttgtcactcatgctggtgtgcagtggcaccacggctcactgcagcctcagtctctctgggctcaaatgattcttccaccccagtgagtccccagtagctggaactacagacacatgccaccacgccaggctaatttaaaaaatttttttatagagatgatgttcttactatgttgcccaggttgggtgtttactgtttctaaagataggggctcttggaatggcttgccctgaagctggccctttgttcttgggttcagcggcccaggctgaagttaaaaagttgccattgggaagtcatgaaggggccctgagaatggagtgatagaggagcttgctagtataaattctggctaagatgcaggattaaaactttgtcccttgtgttgaagaagctcatgcaaccttcagacttcatgtttagcaaaacctgtaccctatttctcagaccctttttttctgtttgctttttggtttcctgtgaaggagagattagacttagatataagactaaaacttgtagctctaagggtaggatcctccttcagccatgggtctctgaagagtaaaggtcttcagtctgaggaacatttttctctcttcagaggaccctagatttatccccgaggactagcacaggccctagtgtttctcttcctggtgcgtttgtgatcccttgttgccttctcctgggaagagatggtacgtgagtagatagaggtgctctgatgcagcccttttttttctcctttctcaccattgaaaagagatgagaattcctgtttcctctggaattatacttttttttttttttttgagacggagtctcgctctgtcgcccaggctggagtgcagtggcatgacctcggctcactgcaacttctgcctcccgggttcaagcgattcttctgcctcagcctcctgagtagctgggactacaggcacatgccaccatacctggctaatttttgtattttaaaaatgtatttttatttatttattaattattatttttgagacggagtctcgctctgttgcccaggctggagtgcagtggcatgatcttggctcactgcaagctccacttcccgggttcacaccattctcctgcctcagcctctcgagtagctgggactacaggcacccaccaccatgcctggctaattttttgtatttttagtagggacagagtttcaccgtgttagccaggatggtctcaatctcctgacctcgtgatctgcccgcctcggcctcccaaagtgctggtattacaggcgtgagccaccgcgcccggcctatttatttattttttgagacagagtctcgctcttgttggccaggctggagtgcaatgtcgcaatcttagctcaccgcaacctctgcctcccaggttcaagcgattctactgcctcagccacccgagtagctgggattacaggcatgcaccaccatgcctggctaattttgtattttttttagtagagacaagggtttctctgtgttggccaggctggtctcgaactcctgacctcaggtgatccacccaccttggcctcccaaagtgctgggattacaggtgtgagccactgcacccggccaatttttgtatttttggcagagatggggttttgccatgttggccaggctggtctcgaactcctgatctcagatgatccacagtccttggcctcccaaagtgctgggattacggttgtgggccactacgcctggcctagaattataaaattaaacaactgtgtgaagatgccaccaaagatatcttcttggtttttcatctgataattagggacctgcaatgtcttttagaatctcttctcttatgtggctaaatcttgctacaccctgctccaaatttgtcacagcttcactgtgctgttataggcttctttaacacttactgcagttaaaccatgtatttcctacccttaacctttgtagttgcttttgagcttaacaaatttaatacatatatttatcttgttagatttaactttggttttaagctgttgaagcctttttgaatcctgaatttctgtccaacaagttggccatcctttttagctttgtggtatctacagatgatcagcatacactgtttttctttttttttttcccctaagttagaatcttggcagagcctttggcatgccactgagcacctttttccaaaatgatcttggcatgttaatctactgttactctgtcatgtgatgtcttgaccagttgtaaatctagccattctaccatcctctgggccatatgtctccatcttgtccacaaggagatcctgggtctgtctagatttcttgctaacacccagatacccgtttgccggagaactctgttaatggtatggagagaatagcttaaaatttctagttggaagaccagggttcaagttttcagctccaccttttataaaccagtgacttatgccaaattgcttaatcttgctaagcttctgttttcttatgtgtacagtaaggatagtttaccctgtctacacagagttattgtgatggctagatgatatttatgaaagtgctttgtaaactgcaaggactacactgttgtcagccctctaaatagtaaccctattaataaaggaatgaagctcatttggcatggcttgatcttattgagcaggctgggtcttggtgatcatgcttctcttttgtgagtgttcactgattgcttagtaatttgtctcaaagttttgtctggaattcacttaaactttccagtttacaatgtctggaatacagtttcctcccttttttgcaaattggggtttctcatagatggagacatatagctcagatgatggtagaatggctggatttataattggtcaagataccacatgacagaatagtattagactaatgtgccaaagtcattttggaaaaagttgcccagtggcaccttctagttggaagaccagaattcaagttttcagctccactttttataaaccagtgacttgggccagattatttaatctctacaattacgactgccggcagcctagtggttcagccgtctcttaggcaagttctctcagtccttaggatgtgattcagctaggtcaggaggctgggactcattcagtgcagctaaatgccttgttaagatcttacccagcttcaatcctttttcagatgtgtttgttcttcattttaagtattattattatttttttttttggcagagaacagttgtaaagtaagagtaaacagttgatctttcttcctgttgtttgtgcatttgcataatctggagatggaatgtgactgactttatatgattttctaaatgctacacatacttaaacattaagtggagaaaaaactctaaaatgttctattttgcatatctaatctctatggaaatttgaaatgacctgtatttactttttagttcacagagcaaataataataatatctaaagggtaaaaaccagcataggcttgatattcaaaaataagtaatttattttcttcttaaagcttttgcttgggaaattgtatgtttgatatgtgaaaaatgcattatctaaaataaatctgatatttacgttgagacgaatatactgtcaatttagaggtttttggcaataaaagagattgacattttaaatcagtctactgagataggaacgtgtaataattctatatggatattttcttttgtctaggtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaaggtaagctatacctgtctatctggcccattatcagggtcatagtaaaatattcataaacgttactatagtataggagctgatttcattgttagtcctctgaacagtgacttcatgtgttcagttaaagattgtattaatgtgaatgttaggagagatgggcttatgtaatgtttactaggagtttttaacaggtatgtgttctttaaaggtttttagctttgcttctaaaatctcatacctgttagatattaaaatactgtaacatctttcccttctactcaaaaaaatatacttttgcctatcacaattcttgtttccatttaggctaaacacaactaagggagatgcatctaccttaataggcatctttcctatgagagagtgaagacacttgaaatgattatgggcaaattgttagtaagccaaaagattcctcttgatagtttgtttctgatttttttttccatcttaggcaagggccttaaatatcataatatagggataccttcaaggagcagtagaacatgtttccttttggtaaagttctggttagagcttttggtctgtcatacggtgagggactttgaaaaccagctctgtaagtttttaactttctaaatatagaagggagattactttggaaaatctgaattaaaaaagagaagtctccagaactctggtctgtaggctcaggtgtaaacagcataccatgcatgaaatgcctggtgtagtctggcccctaactagactagctgttctgaattctgcgtgagtgctgctctgtagtcagactcgtaagtcagacattcctctaagacctcctaaagatctttcccatcatgatgtctttttgtcttcttcctcttccttctctccatcaccacatctcattcttgttggttctttaattctgccttgtgaggagaagtcctacctaaccactcaggcccacagcgatcacaccttctctgaacctatatgatactttctgcatcactcttgtatctctcactgttttattgcttatcttttaaaatgtgtgtctcctttccccatctaaccaactcaaaggcaggaactctgttgtctctattttaggcttccacagtatctggtgcaatactggtattttaatacttagtacttatcttaggtgtcaattaaatgcgtgttgtttgtatttattgatttcacatggaattaaaaacaggaaatgggccgggtgcagtggctcacgcctgtaatcccagcatgtttggaggctgaggcgggtggatcacctgaggtcaggagttccagaccagcctggccaacatggcgaaaccctgtctctactaaaaatacaaaacttagccgggtgtggcggcatgtgcttataatcccagctacatgggaggccgaggcaggagaatcgcttgaatctgggaggcggaggttgcagtgagccgagattgcaccactgcactcagcctgggtgacagagcgagactctgtctcaaacaaaacaaaacaaaacaaaaaaaacaggaaacggttgggagtacttagaatattgtttataagcaggttcttctaaaatggtgtaatagttttaatactttcttgttatcttatttaggagcctactaggctttttcttcgtgcctgggatagtctcatgagtagtattgtcactgtgtctctttcctctttgtaagcctactacctttcagtgctcagttaatttgtattgatgaaaaaaaattaatggcatttgagttaattaggcttgtgcctttacttttctcttttgagaaacatgactaccttataaatggttttgctatttggtaattaccttgttttctcaaaagtatgtgtgcataagtgttagtaaattctgagagggtactcaactgagaattagagttctcttcctggctaatgttttaggaaaattagctgaatattttcaatggtaagtattggtgttatgatctcatctcccattatttgaagttttagttgtttatttgattctgatagttcacaaaactgtcatctaagtttacttaattagttgtttttataaaaactgacattcaaaatggagggaactgcctttgccattttgctagagattatgtcagaatgaatgtaacatttctcttttgcccatcagtttgatttttttttttaagattgagtgaagagtaaatcatcttttaaagttggttaaggttttaattgctcacatatactatactgtactttagaaaaacatattattgttctgaagcagggttagcaaagagtcagatagcattttaggctttgcaggtcatatagtgttataattagtcagttctgctggtgtggcatgaaagcagccatagacaatatataaatgaatgatcattactgtgttccaatacaacttcatttacaatatagatagtaggccagatttgtaaactctatttacaataaaagatggcaggccaggtttgacccattggccagcattcaccaccactgttctaaagcagtttttctgaaaatcacaagttacattttaaaaagtaacttgatatttttgaaagggaaatctctggtgtttagctcttctgtttttttttaatgtaaaggttaccttgtttcttttagctttagaactttggaccctgcctctgaatttaggccttctgaatgaggaggaaggagcctcagtacctgaggaacaggtatttcctttcctgtcattgggcaaatacctggaaatggtaggtagacctaagttaccatgtaggaggcatgcactcttggaagggtgtcagtcccagggccattagtggtatttttatttcttattctgggcttcctcttatattacttgattaggtttggggctatgctatagttttttattcttcttcaagtaagccagagcaatagacacaagcttgagccttagggctttacatggactagatccacctttactagatccacctttagctgaatgtggaacatctccccgctcctggaggtgcttggctcttcctaggcaattttctcatcattttgctttaggtctgacttctttagggaaaacttagtggtgtcatttgcttgcaactctagggtaagtgtcgttttctgcatcatagcccagaatctgagaatctctcttctaaggttgggttgacagttctaagggaactcacttcattttctggaatttcttgaggaaactccccagtctgattcaggtatgtttctatcagttctttgtgacaaatgacaatatgtagaaacttggcctcaagacttttttcagtaatattagatacttctcttgggtttcccataagagatctggaggccagcttaccacttgctaatacaatgggtttcctactattctcaaaattctcagtggtctactttggaaagtgagggtaagggctgggacctggacctctatcttcatcttcagtcctagccaaaatactttgatctgttttatagatcattcttctttataagatttcccttggaaaaaatggtcctgcggtgagttttaaaactgttgttccggggtatcctgggaaacttggagcctccatctttggctaagtgtctttttctaaaattagagcagcagtagcaggtatttatttctgaagcaatgcctgcatacctcattaattttggggacctattaggctattccttctggcttgtaggcccttctctaacagaccttagcttcagagggactatgagcactgtaaaatcacatgcagaattcttgcaaatatgtgtttaaaaaaattaaaaaagaataccaaggccattctgcttcaatgtgagcagcaagggtggcggtgggtatttacttgttcattcaacaaaaacctattgagtgtctgctattatgtgttaggcacatgttagacatagaaaatccagaagtgaagtttatgttctagtattcccgccttcctcccagaagctttcgagttctcataggagtggtaggtttagattccagagtgcttaactttacgacgagtaagaagtagctttaaactgaagacggtatgcctagccctctctgctgataatattagggagcttcattggaccactgcttgctacatccataagtcacctgtcctgaagctgttgctgtctctcctccaggcttgtcagtgatatctgtctgtcttcttcagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtttgtttatttttttttttctaatttatttctgagctccaaatacagttcatctttaaactcagtgagcggtagactcattggggatttaaattttggcatgatggtttacaaacaaaggttaacagttcttagaatggaaactctcaggcacaatataactttagccctgatgaagttattttaccttcagtcatgattttgctaatgtagggagggactcagtgaattatgcatgtttgatagtgatgggagcagtagcttgtttaataggataggccaggcgtagtggctataattccagcactttgggaggccaaggcaggtgtatcacctgaggtcaggagttcaagaccagcctggccaacatggcgaaaccccatctcttctaaaagtagaaaaattagccaggcgtggtggcacacacctataattccagctactcaggaggctgaggcaggagaattgcttgaacctgggaggtggaggttgtagtgagccaagatcgtgccactgctctccagcctgggcgacaagagcaagactctgtctcaaaaaaaaaaaaaaaagaaaagaaacaattaaccaattaaattagagcctatagataatatattacaaagtagttatcaaagtagagtctgaaaacttggtagtgacaagatattttactcagcaaatgaaacctccaaagtcttttaactgttctatttggaagtgtgccagtttgctattcattagctagccattaaatgcctccagttttataagactttacagtgtatttcagaatccctgctttgtatatagcacagtgtatataaactataagttgatcatctagttccaagttctcttgttgcttattcattggtgtactctgttgactaacacatgtgagtgtgcttgtgttctcacacagatgcagtattcagggaaatatctaaaaggaagcatggaatttcagtgtgggaagggatgcaatgatagtaatactctgtctggtattgacaatagctggacagtcattgattcatcacctctctgctacttactccccatgccaggggtctcaacagcatgaggcagacaattcatccccctcctgggctctttgttgttgaaactttggttttgctcatttgaaacacacattcttacaacttttcctgtgagtcccaactttgccttctggagctatgcggtgtaaagaccactgctgtttttccacctggttccagggcttagaacaggggaacagccccattttcatggttaaggctctgtccttcccaacaccagtccttttgctccattatttgtctctctgtctctctcccttgaagggtggctttcaaatacttggagcattgtatggcaaagtttggaggtaaaaagacatgggtgtttgttgtgattccttcacttactggctgcatgaagtcggagaagttacttaaactttctgaatctaagttttctcatcttcaaaatgggtataattagcagttggtattaggtattacagatacctaccctgcagaattaatgtgaggattatatgaggtcatttgtatgaactatttggcatagaaactgactcatagtagtcagtcatcataggcagtcatccttttccttctcccctgtgtccctctgtcccccttgctggaggattaaggccttcaataagaactgaacagggcaacttgaaatctttcaaagtaaaaattttttgatgtgtctgtgattttgggtacaggaactcctaagaattgcttctcatttttactattaaatgattatttgaaagtcaaaacttaatattgcacttattttaattttttgaccagttctcccaaatcagtgtcttaaagattctgctttaaaaataagtttgccaaagatgtgttttctttttgttggtaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccaggtaggttattgtcattgccctgccttccttcacctgtctgaccttaggcagctttctggcattcatggaatacattataacaaaggctgggtctgttattactgtactttagatacagaattgagccactttttaaatatagatataacagtttggctagtgcctgtttaaaacatttcagaataatcaagtattcttgagaaacagataaattttataccctacttcccccacaaaaaaattccactcttattttgatcattaaaatatgcatgatcattaaaatatgcctaatcattattttaaagaaacaaaccatagaaagatataatagaaaagttctcctgaaatcctaccatgtatatttatatataattttacaggaatgggaccatattatacatgctactttataaccaaagtaggcagtttttttataataataattttacctttttgccatttatatttaataccatcgctgttttataagtacactcttaggttcatttttttcagacttattttttcatttcaatcgtgattttaatatgcaagcataccttgttttattgcacttgactgtattgagcttcacggataccatgtttttttttttttccaaattgaagggttgtggcaaccctgcatcaagcgagtctgtcgggtgccatttttccaacagcatatgctcactttgtgcctctgtcatatgttggtaattcttgcgtatttcaaacttttactgttatggtgacctgtgatcagtgatctttaatattaccattgtaattgttttagagtgccacgtactacacctatataaaatggtgaacttaactgatcaatgttgtttgtgttctgacagctccactgaccagctgttttccgtctctttcccactcttgagacacaatgatactgaaattaggccaattagtaactctataatggcctcaaagtggtcgagtgaaaggaatagttggatgtctctcactttaaatcaaaagctagaaatgattaagtttaattaggaaggtgtgttgaaagccaaaacaggctgaaagctaggcctcttgcaccaaatggttagccaaggtgtgaatgcaaaggtaaagttcttgaaggaaattaaacatgctacaccactgaacacaggaatgataagaaagcaaaacaggcttatttatgatatggagaaagtttgagtgggctagataggagatcaaaccagtcacaacattttcttaagccaaagcgtgatccagagcaaggcctaactgtcttcagttctatgaaggctgcgagaggtgaggaagctgtagaagaaagcttaggaagaggccgaggttggttcatgaggtttaaggaaagaagccatgtctataacgtgaaagtgcaagctgaagcagcaagtgtgatggagaagctgcagcaagtgatccagatgatctagctaagatcattgacgaaggtggcctcactaaacaacagattttcagtgtgcattaaacagtcttgtattggaagaagacaccatctaggacttctatagctagagaggagaagtcagtgcctggcaagctgaagccagtgctcatttaccatttggaatatcctagggcccttaagaataatgttaaatttgcgcttgccttggcagcctatatactaagaatgatgttaaatttattctggctgtgtgcagtggctcacacctgtaatcccagcactttgggagtacgaggtgggcagattagttgagctcaggagtttgagaccactctgggcaacttggcaaaagcccatctctacaaaaaatagccaggtgtggtggcttgcgcctgtagaacacacctcccaggttcaagtgattcttgtgccttagcctcccgaataactgggattacagaggtgtgccaacatgtcctgctagtttttgtatttttagtagaggtgggggtttcaccatgttggccagtctggtctccaactcctagtctcaaaacaatccacccatctcagcctcccaaagtgcttggattacaggcatgagccactgtgcccagcgtgactttcaaatcttaagaaatacagctgaccattgaacaacatgtatttgaactgtgtgggtccacttacatgtagatttttctcaattaaaaatagtggaaaattttttttgaaatttgagacaatttgaaaaaatgtgcaaatgaaccgtgtatcctagaaatattgaaaaaattaagaaaaaattaggtatgtcgtaggcataaaatatatgtacatgctagtcttgtatcatttactaccataaaatacacacaaatgtattatactaaattaaaatttattaaaacttatgcatacaaatgcttatagactatatacatgataccatttgcagtaatgtaaacaataggtaaagaaatgtaaacaaacataaaagctgcagtattaaatcataattgcataaaattaactctggtacatactgtactactgtaataattttgtagccacttcctgttgctattgcaatgagctcaggtgttgtgaatattcactgaaaactccatgtgacactaatcatctctgcttgagcagttaatctcttcagtaaatagtgtatctcagtaaaaagtgatgtctcagttttcatttatttttcgtcatatttaatttacaatactgtaaacctggaataagtaataccatgagacccataggaagtgccaccagtggtgctggaagtgctcccaagaagcagagaaaactcatgacattacaagaaaaagttgaattgcttgatacgttctgttgtttgaggtctgcagctgtggtcacctgccagttcaggcagacaattgactttgtaaacagatgacataaacttatggtatcaataaacacagtacagtgctgtaaatgtaaatgtgttttctcttttatatgatttttttttgtttgagacagtctcactttttcacctagtctggagtgcagtggtgcgatctcagctcactgcaacctctgcctcattgcagcctctgcctcccatgctcaagtgattctcgtgcctcagcctccccagtagctgggattacaggcgtgagccaccatgcccagctaattttttagtatttttagtagagtcagggattctccatgttggccaagctggtctctaactccaggcctcatgtgagccgccccacctctgccttccaaagtgctgggattacaggcatgagccactgcgcctggcccttttttatgattttttttaaagagggggtcttgctgtgttgcccaggctagagtataatggctattcacacctcctgggcgcaagctgtttagattggtgcaaaagtaattgcggcttttgccatattttaattacttttgtaccaacacaatatcttctgcttcaagcctacaagtgtctgggactatgggtgtgctgctgcatctgattttccttatgattttcttaataacattttatttagctttctttattgtaagaataccatatataatacacatacaaaatatgtattagttatttgttattggtaaggcttctgattagaagtaggctattagtagttaagttttgagggagtcaaacattatacatagatttttcaactgtatgaggggccagcacctctagtccctattgttcaggggtcaactgtacattctgtaaggttatagctaccatatcaacattaacaggagtttggaagaagttgattccaaccctaatgaatgactctgaggggttcaaagcttcagtggaagaagtcactgcagatgaggtggagaagtagcaagagaactacaaattagaagtatagcccaaagagatgactaattgctgcaatgtcatgataaaactaatggtgaggagtcttatggatgagcaaagagtttcctgaggtggaatctactcctggtatagatgccatgaacattgttgaaatgacagcaaagtatttagaatattacataagcttaattggtaaagtaatggcagagtttgagaggattgactccgattttgaaagaagttctactatgggtaaaatgctatgaaatggcattgcatgccacagataaattttttgtgaaaagaagagtcagtccatgtggcacacctcattgttgtcttatttttaaaaactgccacagccaccccaaccttcagcagtcaccttcctgatcagtctgcagccatcaatgaggcaataccctccaccagtgaaaagatgactctagatgacgcaaacaaatggaaaaacattccatgttcatggattagaagaatcaaaatcattaaaatggccatactgcccatagcaatctacagattcaacactattcctgtcaaactaccagtgccattttttcacataactaggaaaaaacctattctaaaattcatattgcaaccaaaaaagagctctaatagccaaagcaaatcctaagcaaaaagaacaaagctggaggcttcacattacccaccttgaaactatactagagggctacagtcaccaaaacagcatggtactggtacaaaaacagatatataaactaatggaacagaatagagaacccagaagtaaagctgcataactacagccatctgatttttgacagagtcaataaaaacaagcaatggggaaaggactctctattcaataaatagtgcagggataactggctaaccatatgcagaagaatgaaactagactcctacctttcaccatatacaaaaattaactcaagatggattaaagatttaaatgtaatacctcaagctataagaatactagaagaaaacctaggaaacactattatggacatttgccttgggaaggaatttatgactcagtcctcaaaagtaattgcaacaaaaacaatcgacaagtggtacctaattaaactaaagagtttgcacagtaaaagaaactatcaacagagtaaatggaaaacctacagaatgggagaaaatattcacaaattatacatctgacagagatctaatatccagaatctataaggaacttaaagcaattgaacaagcaaaaaacaaccccgttaaaaaacaggcaaaagacatgaacagacacttatcaaaagaagacatataagtggccaagaaacatatgaaaaaatgctccacattactaatcatcaaacaaatgcaaatcaaaaccacaatgagataccatctcacaccaggcagaatgggtattattaaaaagtcaaaaaaacagtagatgctggcaagactgcagggaaaagggaatgcttatactctgctggtgggaatgtaaattagttccagctactgtggaaagcagttgggagatttctcaaagaacttaaaatacgactaccattcaacccagctatcccattgctgggtatatatccaaaagaaaacaaattgttctaccgaaaagacacatgcacttttatatattgcagcacgattcacaatagcaaagacatggaatcagcctagatgcccgtcggtggtagactgggtaaagaaaatgtggcacatatgcaccatggaatactatgcagccatgaaaaagaattaattgtgtcctttgtagcaacatggatgcagcttgaagccattatcctaagtgaattaacacaggaacagaaaaccaagtatcacatgttcttacttataagtgggtgctaaacattggacataaaactcatggacataaagatgacaacattagaaactgaggactgctggtgggggaagaggagcagtgttgaaaagtccagatgatgggatcatttgtaccccaagcctcagcatcatgcagtatacccagataacctgcacatgtacctcctgaatctaaaattaaagttggaaaattttaaaaagggaaaggattatgacttggtgaaggcacagataaattattagcatctttcagcagtaaaatattaatatttttaaattaaggatgtgcattgatttttaaacatataatcctattgcatacttaatcgactacagtatagtccaaacataacttttatatgcattgagaaaccaaaaaaacgtgcatgccttgctttttgcaatgtttgttttattagggtagtgtgaaactgaacctgcaagatctcgaagttatacccgtataactctagatatagataagggttctttaaaaaatataatacccttatcacacccaaaaaagttgacaattctttaataccggttagctagtcagtgttcaaatttccaggtacaattgaccctctgtgggttctgtatccatggacacagccagtcagagatcaaaaatatttggcaaaaaatttcacaaaattccaaagagtaaaaattgaatttgccttctactgcctgagtactgcatcgaatctgtgcaaatgaagggatgtgtatgcattgtattaggtattataagtaatcttgagacgatttaaagtatataggaagatgtgtgtaggttatatgcaaatactaaattattttatgtaagggggcttgagcatccgtggattttggcatctgaggggtgttctgcgtcaatcccctataattctgaaggacaactgtataggttcctgcttttttctttcctttttttttttgacagggtttcttactctgtcacccaggctggaatgcagtggtgcaatcacagcttactgcagccttaatctcttaggctcaagtgatcctcctgcctcagccacctgagtagctggaactgcaggcgtgcaccaccatgcttggctaatttttatatttttggtcaagatggggttcctccatgttgtccaggctggccttgaactcctgggctcgagcagtcctcctgccttggcctcccaaagttctggtattacaggcctgagtgaccacgcctggcctaggtttctgctttatttttctttgcaatttttttgttgaagaaactgggttgtcttacagagtgtttcacattttggatttgtccacattgttaattactatattcctctgccccgctgtatttcctataaactggtagttagatctagagacttgatctcattcaggtttgatagggggcaaagagagggggtgacaggaacaaaaactttataggtagtgttatgtatcagaaggtagacttctctttttctgagttaatgtttagatctttattattatttaaactaaaaaatgaagctttggaatattttgttaattctagtatatcacagagaacatgaatattatgaatctagccatgagcggtggctcacacctgtaatcccagcactttgggaggctgaggcaggatgattgctttaaaaaaattatgaatctgtttttaagtaatgcttttatcttgattataatcacagtacatgcttataatagaaaatttggaaaatgtagggacagatacctatcattcagagccaacccatgttaacattttaatgtattttttccatttagttccctttttaaaaatgccagtttgaaattattctatataatattatctacttttttcatttgatgtctgattcttgtcactttagttacacaaactttttctcattaaatagctgttgagatcatatttttaatggttttgtagttttccattatataattggaattataattcatttaataatttccttgttattgttgttgttatttttgtttttttgaggcagggtcttgctttgttgcccaggctggagtacagtggtatgatcaggactcatagcagcctcaacctccccaggctcaaacaatcctctcacctcagcctcccatggcagctgggagctacaggttcatgccaccacgcccagctaatttttgtattttttgtaaagatgaggttttgcatatcgcccaggcaggcaggactcaagctcctggactcaagtgatccactagacttggcctcccagagtgctgggattggagtgcaggcgtgagccactatgccagcgttgtttttttgtttttgtttttcttttttttttgagatatggtcttgctctgttgcccagggtggagtgcagtggcgcagtcatggctcattgtagcctcgaactcctgacctcaagcaatcctcccatcttcccctgctgttttgatatttatgttgttcccattgttttattttaaaaatattggtgatatgaatgctttatacatagtctttatatgtgagaatattatctctaggtagagaataattgagttaaagggctttgaatagttttaatacatttagaatattaagtaattaagttgttgagttatttttatggtatgtcataaattctaaacttcatgtaaaactattataacttagttatatggcagaaatttgcagtgagatgaatcttttaaaaaatttacatattgtatgattatataattatataagtataattacatatataaatagctataatttataagtaatatgcaatgtgtatatgtcaaacatattacatataaacatataaatgtcacagaaagacatttaaaaactaagatcactgacagctgaaaaacacaaactataactacaaaatgggaagaaatgataaaaaatgattaacatacctaacctataaaaaggtcataaagaataattcagaatcactgatacacaagtagaaaaattaggctagtcaaaccagaaagagaagagatgcaaggaaaaactttaagaatcagtttacaacagaataaatgtcccacagagcacatggatgggcctggaagagggacaagtaaaaagtgatgaagctgaactgaagagaattactatataaaagatagggacagcaggaagtaacagtattttaatactaattattttaaattatttaagtatcttaaataatttaaaacactctttttttggtatacttgtttattttacccaaaaactcatgtatcttgtaaagaagatgctgataacaacacgtgtattacatataaaatatatacaacagcatatactcttcttcccagcttctttccattagaaatcatcttgaaagtctccaatttgttttcaatgtaaaacttctttttaatgaacgcataatagttgtacatatttgtggagtacataatgatgttttgatatatatataaaaaatgtgtagtgattgatcagagtaattagcatatccatcatcccaaacataaaaaaactagaaatcctctttcagtttgtctgttttataaatgagggtttccatatgtcttgttcacgtatgtgaggtacacatgtttcatccattttctctgtcttctttctatgcttgagtgtatttttcaatctgttaagaaatggactcagtggtgtgcatttattttctagattgctacgctttacatatggtccttcatttcctgcatttaaagttcccgatgaagatgccagtctgatccctccagaaatggataatgagtgtgttgcacagacatggtttcgctttttacacatgttaaggtattgttattttattatttcatgtgccatttacctagtaagtatcttagggcaggaatcatgctgtaagtctcttgtttgaattcagaaggtggacactaagccccattcatcaaatggaatccagctggacaacaagcacatttctgtcctgtgcctcctgctctccccgtcccagcagggttaggctgtcctcagccgctcttggtttacacgctctaggaacgcgttccctgtggtagatgccgcacttgttctcttgcctgttactgcagccaggctgatgatctttctcttgggattttgtcacattctgtggggactggaggttgccttgctcctctctgtgcccagcactgactggtcagtctgcctctcagagccctcctccaatagcctgtttaaagtttcaatgggagatacaccctaaaatttcacagaggggtatactgctacttcctgctgtccctgtcttttatatagtaattctcttcagttcagcttcatcactttttacttgtccctcttccagccccatctgtgtgctctgtagaacatttattctgttgtaaactgattcttaaattttttccttgcatatcttctctttctggtttaactagcctaatttttctattttgtgtatcagtgattctgaattactctttatgacctttttataagttaggtatgttaatctttttttatcatttcttcccattttgtagttacagtttgtgtttttcagctgtcagtgatcttagtttttaaatgtctttctgtgatcattttctatttcctttgtgttctttgatcagatagtcacctatgatttcttccaatgttgtttcctttgtaatagtaagttcttttatatacctcaggatctgtctttatatgtatataaacacacacacgcacatacacacacacacacacacacacacacacacacacagacacacgcatgcatgtaatttgcagagatggggtcttcctacgttgcccaggcggtctcaaactcctggacttaagcaatccacccacttcagcctcccaaagtgctagggttacaagcatcgagccaccgcacccagcctggaatttgtctttagttcacatattactgcattaaattcatttgtttttatatcagattcacactcttattttaactttataatatttactgatatttagtaggtctaatgtctttttctctttttccttctcttagaatatttatctcttcttgcctgtttaacatttcagatcaattttagaaccaatttttcaagttacaaaacataagcaaacagaaggaaaaacctcaacgaaaccttctggggtttggattgtgtattatttagggtaaggaatatgtgctgctttagcaaatgaacttgaaaatcttttatagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggggtgaacccgggaggcggagcttgcagtgagccgagattgcgccactgcactccagcctgggcgacagagcgagactccgtctcaaaaaaaaaaaaaaaaagaaaatcttttataaagtctggagtcaggactggctctgctcacatagtcgttcagagacccagctggcagaggctctttcatcttcaacagatgactccattagggcctcagtgttataagcaggattctcgtatctggctagcagatggggaacagagagcaaggaaaattttgtgggagggttttatgtgtcaggccttgaagtaatataaatcactgttactcatattccattagccacaactcagacacacaccacacttaattgcaagagaacagagaagaaaagagaaagtggtgaacagctagccagactctgccgaagatgagaattgtattaagcttgtatttatatttaggaaacgctgatatctgatattgagtctgcctttcttttttttttttttaatttttttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggagtggtgatgactcttaacgggtatgctgccttcaagcatctgtttaacaaagcacatcttgcaccgccattaatccatttaaccctgagttgacacagcacatgttttagagagcacggggttgggggtaaggttataaattaacagcatcccaaggcagaagaatttttcttagtacagaacaaaatggagtctcctatgtctacttctttctacacagacacagtaacatctgatctctctttcttttccccacatttcccgcttttctattcgacaaaaccgccatcatcatcatggcccgttctcaatgagctgttgggtacacctcctagacggggtggcggccgggcagaggggctgctcacttcccagacggggcggccgggcagaggcgccccccacctcccagacagggcggcggccgggcgggggctgccccccacctcccggacggggcagctggcgagtctgcctttctaagagcatgtctttttctttttttagaattttgcgtatcttcttgaaatgttttacagttttcttcacaaagatttttaatattttctttaccattatttctaggtatttgttgctgatgttttgaaaagctaactcttttctgctattctgtcttctagatggttattactgctgtaaagaacattttttactgcatgttattttgcatattatatatagcatttaaaagagctctgaatatttcactgattcttctgagatatgggcacatatctgcaaataagaagtgtctcttttctaataattcatacttgttttggtgactaattaaaagtacttcggatgcagtaagacttggacctgacttaaattctgctagttttttctttgtgaacttgagcaatttattctctctgtgcctcagtttctttttaatctacataatgggaataatgatagtaccatctcgttataagtattgaagaagaaaaagcatgtaaaacggcatgatgcctagtgcatggtaggtgcttgaaagttgctattattacagttatttctgtatattattttactgcatccatcagaagtagaacactgttgaattaaagtgatactgttttggcaccttttttggtctgattttcatcggaatgcctctgatatatggaattttgagtaggatgttggttgttgatattagatgttcttttttatgctcctggtttcctaagcagttaaaaattttatttatttttatttatttattttttgagatggagtctcgctctgtcacccaggctggagtgcagtggcgcaatctctgctcactgcaagttccgcctcctgggttcacgccattcttctgcctcagcctcctgagtagctgggactacaggcgcccaccaccatgcctgactaattttttgtattttttagtagagacggggtttcaccatgttagccaggatggtcttgatctcttgacctcatgatccgcctgcctcggcctctcaaagtgctaggattacaggcttgagccaccacgcccggccagcaattaaaaatttttaaaaatataggccaggcacggtggctcacgcctataataatagcacttttggaggccaacgcgggtagatcacccaagcttaggagttcgagaccagcctgggcaacatggtgaaaccctgtctctactaaaaatacaaaaaatgggctgggcgtggtggctcacgcctgtaatcccaacactttgggaggccaaggtgggcggatcccttgaagtcaggagttcgagaccagcctggccaacatggtgaaaccctgtctctactaaaaatacaaaaattagctgggtgtggtggcacatgcctgtaatcccagctacttgggaggctgaggcaggagaatcgcttgaaccgggaagcagaggttgcactccagcccgggcgacagagcggcggcggtggggggtgggggggaagcaaaaaacaaattagctgagtatagtggtgcacctgtaatcctagctactcaggaggctgaagcacagggattgcttgaacccgggaggcagagttgcagtgagccaagatcataccactgtactctagcctgggcaacagagcaagactgtctcaaaaaaaaaaaaaaaattaaattaaaatataaataaactatagtaccgaattgtttcgaataatatttttggatccatttaagcaattaagtggtttttcttctttcatctgttgatgtgaaatattaattaatttcccaatgttgaaccatctatcattcctgaaagaaaagttttgcttggttatggaatgcttttcttttaatgtttttctgaattgtctgtagttctatcttttcatgaattggataggaaaactttctgtccttttttatggtctgttgtgtcaaagttttgtgttccttaagagtttgaaataaatgaacagtaaaactctagtcgagtcttttttagaggtagtacttagatagtctttcttcttgagctgactgtggtactttagtcagagttattttggatggcaaaaagaggagccaacttaagcaaatgcaggtgagaaaaagagattatgtgaagatagagcagtcttactaggctccatgaagcagcgaacaaccctttctcatgttggggagggatgaaggcaacctcgggacaagccactctgtcatttgtttctctttgcttttttgattctcttgtgcatgcacattgttctttctccagcaggcttgctcctgggtccctttttcctcctgcctttgagagggggacatgcagtctcttgataactgcccagtggtgtaaatagctgtgatactgtttgacttcagtgtttgtcctttcagttcacgggggctttccctttgcttagtttctccaaagggaaaattggatcaaattatcttcgttaattaggtctctggcaggcatctggatacctcctttaggacagttttacctcctttcttaaatgagctgcgactgggtagaaggcaggtcatgaggattttttatgattgtgattatttgtgattgttggcagatttcctaggatgaaggttgaatatgatggggagataggcatcaacattttgtcttgtgtgttagtgatttatctttttccaggaaaaccaaaaaatatttttcatttttgtttccatactgttgtcaaatgcttgtctttggacttgtgtatgcccacctgccctttaggccccatctggagattgtttcagtaaatttaggtctaatctggattttttaacaggttccccaaatgtgtcaggtacacggggcattgggaactgcaggaatgcagttgcttttagtttttcatatcctttgttacccattcttatttcaagttttacttactttcttgagtctgttctctaaatatttgggagccaataaaatcattcctggtttacctctggagaagctggtatgaatctttctctctccagtttttgatttacagtagacatgaatttagccaagctctgtgggacttaggtgtagttccatttcagctttactccttgttcttctaatttctgaatagttgaactacagcccccagcaggcactgctgctggagacgaatctcccttcctctgtcttacttggtggactagtccagttctatggaaacagtgtgctaccactggaagcccatttttcttacatgcacacacgttctcctttccgcaattacagttacttgaaattaagtcttttggtgggtggaaaaagaggttttgaaaggcagagcatgtatagatcactgattcctatttctcagcctagttcttttgccttgtagctagtggaaattctgtttaccggctttagattatcagtattactttgaattggagaggctttttaatggaatgctaagcagaccatttgagtgaaaaatcataatctgttttttaatggaaatatttcaaactgtttgtacataaaatgtaattcaaacacaaatacaccgttttgaaatttatggctttagtacatacacatgaacacaacataaaactattaacactaatcctgattttcaaatatagttgtttttttttaattgaaaatgttaatattaaagtaaaattttctccttggagcttttgttgacatatttatagctttaccattccattgctttttctttttttctttttttctttttttcctgagatggcatgttgctctgttgctcaggctggaatgcattggcatgatcatagctcactgcagcctcggccttgaactccttggctcaagtgatctgcctcagccttccaagtagttgggaccataggcacgtgccaccatgtccatctattgcttaattcttaacatattagaaaaagcatctatgtatactctcaaaattaaaattttttctagtcttactttgattctcatgcttggagtaggcaatgttcatgtaaccacactgcagatcttctgtaaagaagtgttgagatttgaatcgctggcccattaaatacaaatcagtctcttttctgaatcagagaaataggcacagtcctattcttaaattagattacgtgtattttattgctatagaaatttctaaatttgtgattaattctttcctctcttttaatagtaatcctgtggatttgagtaacccagctattataagctctactcccaaatttcaggaacagttcttgaatgtgagcggaatgccgcaagaattgaatcagtatccctgccttaaacatctgcctcaaatattttttcgtgccatgcgtggaatcagctgtctggtggatgcattcttaggtgaattttgtgtatgttgctagatgtatgaagagcttcatttagataactctagaggctaaccctaggagttattagaaaacatccgaaggaaaagatgaacagatttgatgacaaataacaagcgaggaaaaattatttgcaacaaataaaatagccagagggttatcgtttctatgtaaatatttagattggtgcaaaagtaattgcggtttttgccattaaaagtaatgcggccaaaactgcagttacttttgcacccacctaatacatcaaacaaagtgctaagaacaagaattaggcctagtagataaatggacaaaggataagagtaaatgattgcaaaagaaaagagtgttcatgcatactagctatccaggaaaatacagatgaaaatgcatttgggaccattctcatgtatatcattaaaaagcaaattatacctttagtgagccattcttttaagctgtttttcacattttagatatatgaaaagtcaattttttaacctgttgaaaggcagtgatttataatattttctaaaatatttatgtatacttattaatgtacagttaatatgttagctctgattaagtttggctgccacgtaacaaccaaaaatcctattgtaaacaagatagcttattttcacatatgttaaatctagggctaggcagtgtaatggttccatcaccagcagggatccaaggcccttccatctggtggctctccattctttgcacagtgcctcatgggccatgatggttgagtgagttccaaacatcctgtccaggaattaggaaggaaggagagtctgcatataattggtcctttaagaagatctcttagaagacctacccaacagtcaccaacttctttatggtcaaaatatggccacatctaggtgcaaagggagtttgaaaattgagtcattttttttctgggtagccatgtccatctaaagtttgtgttctgttactcaggaagaaatagtgagtagatactgagaggcaactagcaatctctgctatagtctatgtgtcccaagccttcactaggttactgggagaaattttctgatcatatattttgacctatgaagaataatttcatttgtcttttttttttttttaaggtatttctagaccccgatcagacagtgctcccccaacacccgtgaatagattaagtatgcctcaaagtgctgctgtcagtaccacccccccacataaccggaggcaccgggctgttactgtgaataaggccaccatgaagacaagcacagtaagagtttacatcaccattgttatgctatataaggttggctttttaatctgccattctttttataaagtcttgctattttctcagacttttcattggtatgggtgtattcttgtgttcgtctaataggttagtactgctcatgcctctaaagttcagcaccagacgtcctccacctctcctctgtcaagtccaaatcagactagttcagaaccccggccactgcctgcccctcggagaccaaaggttaacagcatcttgaatctctttggatcatggttatttgatgcagcatttgttcactgtaaacttcataatgggataaacagagacagcagcatgactggtaaatattactcaagaaatatgttatcattattttccttttcctttttctttttctttttagtctttcctacctgcaagattaatatgtatcttaaaaagctctctgtttctgaccaagcaatgtcttgtgcttaaccccttccagctgaagtaacagaacttaagaagttttcctccctgttctttttatgtatgttctatgaggtttggccttttgtctggttttattagacatacttaaggttagtcacattttgttgaatcagatttctttcagtaggtgacctggaagttcccttcatgtcagccaggataataaaatttatataaagaattaaaaattcgaactggaaatttacaagaagtgttttcgattttgacagccattcactcattagtatatgtaaacatcagaaaatttttgcttcacactacactctgacctctcaaattttagtctagagaactttatttcaagggcacactttcaaaaatattatttgctttttaacttaataaaattgattggtggagaattaataactcaaccctgatatcttcatttagattttattataaaaaggaaactgtctaagagctggtggttttttttgtcatcttaactattatatttgaaagtaatggcatagggtgcaggatggatgggtggggtagggcacaatgttttgaatatttataatatgtcttagagagctgaaaaatgacaatggctggcatttattgagctgctgttactattggccaggtactgtgatatatgcattaatgagtgtattgattgtttggtaagaaaccactcttctactggggttggaaatagatcaagacaaaaagatgtctaattagtttatgtatctctagggagactgtcagttccaaggataaaactaatacaatgaccagaagggtctctgctttctctcagaaatgaattcttagctgttactataattcttagctattattattatcatctcagaactaggatctatgtctgtgaacattatactcgtaattattttgaatattcttacaaatctttaatttagaaaagttgtgaatataaagatttttgggaatataatttgagaatgccatggttgagtttagggatgtctttgcttgctttattttgttcaaattcagacactttatattcttccattttcatattataattttatccacaatttgaaagtagtgcttctgggataggtaaatgtgcttacttacaataagtgaaaactttaaaaaaatgactattgggttattcttgtctttatgttcatgtaccttgtattttgagttttctgtaccatgtttatatttattaatttgcattttctagaatgaatcagtcctatttttcttttttctttttgttaagatgtaattcttacaatgtaacttttgggtatagagctgttgacactgaaatctgtgaatctagaatggctcaacctgttgcttggttggtgggcttgcttaaagggaacttatagatctttttgctctccagggagtttgtaacagctttgctcaccctcttgcaccagaagataaaaaccagacttcaaatcatacgtgaacaacatcttactttaaaatttttccttgctggggagaggatagaagctccttttctcctcattgtgttcagagatgataaaggctgttacattacccaggagatatgaggtgtccaaatagttaaaggggttagaatgctaggtgccaatcttgaggtctcaagtctggtgggaggcatgggtatattaactgttttttaagtactggctgccatcaaggaattctgccatgcagttcacctctaacttaaagtgtttgcttctttgaactggttagcttttgatttacatgacagtacactgtgctttgtaaaagtaacattgagctgggaagggttaatgaactaaaattttaatgcacgttatgggcacttcaaaacctcagttctttgtagttgtgtaattttcttcgttcattgttttgcatgatacaaaaatcataattttggacctgaatgcacaatttcctatgtttttgaactagcttgtggtatcgtaaagcttttaatttaacttttaaaaagctaaaaagcttcttaatttattgtaaaatttcaccatctttaaagtattttataattactactgtcctttgatttgtttccatttatttctattatcttgcagcatcttttatccaaattcttctttcttataaatcttgtaagtaggaaccagaagcttctccttaattgcagtcatgtttttatttttttcataattccattaaaaatttgattgtcattgtctcttgtagtttttgcacttgggaagaaaaatacttttctgtgttttgaatggggaagattgttggcaagagcaaattaatctgcctgaatcagtcccattatttctgtatactagtctggtcatgtcatgaattccaggactttgcactaactgtgttttggcttttttttttttttttttttttaaagctttaagcttatttttatacagatttagtgtttgatttgtatgcattctgcatgtagtgtttttcaaatgtattattgctggatagcttatttaggactaaaaatggctcatgggaagttgcataaagatttatgcttgactctgtattctattaaatctattataaaataatttaagcatttcatgtagagtaataaaagatttcagagtgattttcaatacactgtgaaatcttttgttaaaaataaaagcaactttcaaagggcttctgtttcagtgataacaaatgaccatgataatcttttttatcaatccaattttctgatttatcagcctcaagttagctgctgtctgtggttgttaaaattcattctcattttgcttggttgagcgattctttggtgtgtgttttggagttgggtgggtggtgggaatgctctctttttctccctgcccacttctcatccttactttgccctctccctaaagtatacagactggcatagggttgcccatttaattaggatgtccatctggggtaatgtgtaaattgcagtagctatttttcttaacgtttaagcatcattctgtagggggaagaaaaaacagaaaagaaataatagaaaagccaaattctgtattatatatctgtatgtggatacagatatatacaaatgtactctgctgatcaaaaattcagttgaaaaatgcttcttgtaccatctgttaaactgacaatgccactgtaaattaattgtaacctattttcaaagaagatttcagagagccctttttaaaaatattaagacatagttgctaaacaaaagcacttattggattcaagtagctatttaatgacaccaatatttgatctttgtgtccagggtcccatgagcctacgtggcatattgcaaatataataaaaccctccttttctctccccagccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccaggtcttggaatttttgtttgttttttcatttatatagttttgatagtgaagccattgttggttggccgactgaaccgatgagtgatgttggtctgaaatacctacagatgtctgtaagtgatcgacatttgcctgaaatctttcattttacctgtctcatcagatttggtaaagacccttaagaccctttttgttttagaagtgctatttatgtcatcttatttgaatctttttaatatggagagatttcgaaggaccacaattatttgttaacaaatttttagcacagtattcccatgtaggcagtccagaaataagtcagctgtaaatcctgcctccaaggagcttattttctgggcaaagccccaaacaaagccgtgtacacatgtaacaatgatccagcaggaattaggatattgatgggagaggcacagataatgtgctgtgggcattcaggggaagaagcagcgcacatttatttactgtaggggattcaggaaagagttttgggggattaaatgattatgctggacttataaaggatgagtagcatttagcctatgttagaaagttggttagggtcatcttctccaaatctatggcttcagccatctttgttaatgcctctgccatccattcagttgctcaggccagaaacgaagagtcattttagaatcctcttcttctgtatctttagttgatcaaccgatcaaccaactcttgccttcctgctacttaactctctttctgatctctcttttcactctatccccaccattatactttagactttgtcacttttctcctaaattaactcataatggcctcccgttcttcttgacactgttttgccttccttaactgatcattcacacaagtgcagaagtgaggttaatatcaacagagtatttagatatctgcatacttgctaggttctcaggagatagaattaaactgaccctatcagagggaaccaagtacagaattttatagatatgaaaaagaatggtatatacaggcaaataggcagggttatcataactatcggcgcttggtttaagcaacagaaaccctctcaatctgacttaagtaaaaggagaagaagttgtgagaagctagtgatatttattaaattctaaggtcaggaaatgcagtatggcctcatgaagagcagatactcaaggaccaaaacaactttattcctctctctttctctgtcttcctggtctgccagaactgcttcattcttctcttctctgcagatcattttctcttattgtagtgtgcttctgagttcccagttttcattagccgggcatgatggcatttgcctgtagtcccagctactcgggaagctgaggcagaagaatcgcttcaacccaggaggcggaggttgcagtgagccgagattgtgccactgcactccagcctgggcgacagagtgagactccgtctcaaaaaaaaaaaaaagttcccagttttcatggccttggtctaggtgaccatcaggaccaattagtatctctgaattttaattatagactcctgggaaggaggatctaattaatctgcctgtctctggtctagtcagctacagttgtgaaggtgggtcacataagggtgttggagctcacccacttgttgtgggggcatgtttctcaggaactctgggctggggagatatcctaaatggtactttggtagtaggggagaaggctatcaccatgaactttctgactgagccataagactgaatgggtggtagtaggacaaaccaaaacaacagattcatgagagggcaagttattagtttagttttgaatcgattgaatttgaagtgcctatgggatatttatcaacaaatatttattaagtcctactttgtgccagatattgtgcacagaagtaccataataatcactagacatccagatatccagtaagcttttgggtaatagatctggagttcagttgagaggtgtgggttagaatgatttgattatatttagtgacttaagaagtgtttaaaatcaggttagtaaaagagagagctttgagaactaaggttgtcagactgaggaacaccatctttagggggcaggtagagtaagaggacctgtaaaagaaaatggtcatagaaatcagggaagagcaaggagagaagggagtagttagagggctgaatgctttcaaaaggcagaatgagttaagacttagtcatgtctcttggatttggcaatcgagagcccattggttatttgctagtatggttttagttgagttctagggagagagatagattgaaatgggttgagcagtaaccagtaggtgatgaagttgtttctgaagagttttgcagagaagagaaactcacctcacaatagaagagtataacagtgcagctgctgttgaataacgggagattgaatgcttagtaagttgattagaggttgggggtggagttaaaaactaagctatattcaggtatattcctaaaaggaatcttattcaggtgaccttcatgatgaatacagatgatcgaatgcaggtttctttctttcattgtccccccaaaaataatggggaagggacaaaaatgtaaacacacctttttccctaggaattactaaatgttgcaacatttttctcttacggaatttaactcagcagttcccccagtttattgaaaagtactgcagcctgttgttttgttttgttctggttgccttatttgcaggcccctagaactttgagttgcaaggcttaaggtttgagaaggtgcaacagacatgaatttttttttttcttcattaagaaagatgatttgggtcttagtgtatatgattcagaattgttctaattccagtaatatcctttaaagggtaaaattccagtaattccagtaataacttttaaagggtaaaattctaataaattccagtaattccaataatgtcctttctttaaagggtaaaaatagtgatgagtggaaatagactttcagttaactatgtagcaaataataattatgaaaacttttgatcagcagtttgtttaaaatttttttcttgctttcctagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacaggtaagctatcattctctgctattatatcaactgtctgatttggcctggtctgttggtgcttcctccccagtttcctaatgtatcctgtccagttgtcttcatagtccaagagaactcaggcgacattaaatgagtgtagtgtgtccaaacccacctcatccctgaaatccttcagttctcatttgtctgtgggcttgttgaatcgtttttggcctggtctagaagggtaagaacaactccaacacagaggtcttacctttgtagagtaggccttacgttttaggtaaagaaatcaatcaatcaacttctagtttaattcagtaacagtttaacttagaaatatacaatatacaaatacacaatgcttggatttggaaaaattggcattatatgtatttggcagtagctaaaaatgtgctttagttcaaaaatactaatagctttttattttttggcagagaactctcaaaattcaaaagctatgtaaatccaacagaattgcgaagatcctccattaatatcctgctttctttgttgcccctccctcatcattttggcacagtcaaatctgaggtaatgttttgttaaagtttttttatatcctatattctgttttttgtactaatttaagtcaaatcgaatgttaaaaatgaaacaggagctttttttatttttcaattcaagttatttcatcaagttatttcaagtgaattaacaaagttgacttgtgattttttttttttgttctgtcagtttttctaccagttttcaagcagttataggctaaggacatctattaacatattgttagtgacagattcagcacagtggctaatattagactgaaagcctttctcattatactgatccgttcctccatctagctgttcccacatgggcatcataagctgcaacagctgatgttaaatattatttgttttttccataggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggtttgtattcacacgttattttgtaagtgaaaccaaagtactgttgactacaggcctgctgaggaggcggcagtcggtaatgggagcctaaacctaatgtagctctacttactctgaatcagaggcacaagttagttttttaatgtaaaaaaatttaaagcagtgagatgagggaagtaaagtgttacagttgtcttggttggtcatttatttgtgcttttgcttttctttctcttctcccttctctcctttctccactctttgcctctccttcccatccctctcttctttcctcctttcttcctgctctccttcctcctgcctctttctcttcctcccgcctcgtcctcttcctcctgcctcttcctcttcttcttgcctcttcctcttactcctgcccattacttacaggtctcatcagtctgcactttcgtcctagtcctttttttctcaaacacatcagctaatgatttcttcagaaccttactttatatccctcctgctggggtgttctttccctagatttttgtttagcttttcttcatcatcttcttaagagagagcttccctaacaatacttgctaaagattatcttatttcatcatttttttcacaacacaaaacctgaaattatcttgtttgcttaaatgcttaaactccccgctttttacatgtttttcaaaatatatcataaggtatttggtgattgacaaatctagtgttagcactaagggacagtcttatctccctgaaaatcttcagagagaccctgatgaacagaggagctcttcttttcttcctctaatctgatgttcaaattgggtaaacagcaatgtattacatttgaaagcaaagggttttcagttgttgcttctgtgtctcagtgccactaaagtgcaatcctgggtattgagatcaccacccttgacagtggaagctcttaggaaagtagggctttcctcagccacctaacaggagtccccactgaaccatgtgaatgcaaataccatcccagcccacaaacctgggtggcagttagaactccccgcttatggagcaattgatctctgaggatgacttgaccttggcagtggttagaggctttctttcttctcttcattagcaagactagaattcagcttcttcctagcatcttagatttttatctgttcaaaagtgggatcagacattccctttaagcccttatgcccccagaggaggtggggtgtatgtccttccaacaggaacacaatccttgaaatggtttctaaaaggcctctaaaactgagggacagatcctgaagagatgggtcacaacggccaagaaccatatttatccagagacacctaattagtaggtgactggagttgtctgtagctgggcaaaaagttttttagggtttcgtaagtctcaaaagccattaattgtggacatgattttctagactcacaaatggagttttttgctctttacattctcagttatgatgtatagctatattcttgttcaggctgggcttttagagaccttctgaagttaatgtggtcagtctgaccaaggtttggaaccagagtctaccagtggcattgataatatctcagatacattctgaacacagagggtggtttatgtggagggggatgttttgatatgtgagaacctccaagttacaatgttttaggttatttaaataacataattttgcttgaaattatataatttctacgattgaagcagtatttggttttgttacacccttgctctgaggcactccctatgtactttccaaggaagagtcagttgttactcttgccataaagtggcaaagctctttccatcttctctttatccatagtgggcaagagtacctcccacggggatgagaagcagtgtgttaggctcaccatctcatttctgtcctagcctttccaggacaatggtttccttgataataaataaatgaagcttacttcagggtatgcagatgtcaacaagccccagactgtgtggctttaatcattcttaaaaagcagtgtggtcagaaagctattgctgtgactttattttgtaatttttgttttatttatttgtttctttttccctgtagaaaaaacagacagtaatgtttgttttatttttaagactagaacctagttttgaaagtattccataatattttccttagtttatattacccttgaaattgagatgcttacatctggtcttttacaccagttaaaaaatatctgataatgagcatgtttttatataaagcaagtttgaccttcacattcattttatttttatttatttatttatttatttatttatttatttatttatttaaatacaagttcttgctctgttgcccaggctggagcgcagtggtgcaatcatgggtcactgcagcccaagctcctggactcaagtgattcttctgccgcaacctctgaagtagctgggaccacaggcgtgtgccaccacacctggctaattttttgttgttgttagaatagggtcttgctctgttgcccaggctggtctcggacttctgggcttctccagtcctccctccttagcctcccaaaatgctgggattacaggtgtgagccactgtgcctggcccacatttattttagggaattttttttttttgagatggagtctcgctgtgtcacccaggctagagggcagtggcatgatcttggcttattgcaacctctgcctcctgggttcaagcaattcttccacctcaccctcctgagtacctgggattactggcacccgccaccacgcccagctaatttttgtattttttagtagacacaggattttaccatgttggccaagctggtcttgaactcctgatagcaaatgatctacctgccttacccttccaaagtgctgggattataggcatgaaccaatgcacctggccagaattaaggaatttttaaagagtctcttctgaccaatcagtggatttattagtagagttgacccttgaacaacatgggtgttagtgatgccaattccctgagtagttgagatccacatataactttttgattccctaaaaacttaactactgatagcctactgttgaccagaaaccttacccataccagttgattaacacatattttgtattttatgcatattattaatatatactgcatttttacaataaagtatgctggagaaaagaatattttattaagaaatacatgttgtaatcccagcattttgggaagctgaggtgggtgactcacgagaccaccctggccagcatggtgaaaccctgtatctactaaaaatacaaaaattagcagggtgtgatggcacatgcctgtagtctcagctacttgggaggctgagataggagaatgtttgaacacgggaggcggaggttgcagtgagccaagatcatgccattgcactgcagcctgggcaataagagcgaaactccgtctcaaaaaaaaaaaataaaataaaaataaaaataaagcttgggcgtggtggctcatgcctgtaatcccagaactttgggaggccgaggtgggtggatcacgaggtgaggagttcaagaccagcctggccaagatggtgaaaccccgtctctactcaaaatacaaaaaagaaaaaaaaaattagccaggcgtggtggcaggcgcctgtaattccagctactcggaggccgaggcagagaattgcttgaacccgggaggtggaggttgcagtgagccaagatcacgctactggactccagcctgggtgacggagtgaggctccatctcaaaaaaaagaaaatcataaggaagagaaaatacatttacagtactgtatttattgataccataaattgtctgtttataagataaatcgtctcaactgttgggcagttgtagctgtagaccccaatctacagtacatatcaagcaactcagctttttcttgtaatgtcatgacttttctctgcttcttgggagcacttccagcatcactagtggcacttcctatgggtcccatggcgttagtcaaggttcatggtgttgcagtaaacatgatgaaaacatgtgagaaccatggtatgcaatttactgcagtgttcagtctgttagagagatgaactactcacatggagatggttagcatcacattgtattttaagcagcatactcattaacacttgagctcaccccagtaacaacaggaggaggctacaaaatgattacagtagtgcagtatgtactacagctaattttatacagttatttaatactacatctttgtttacatttctctggactgcaaatggcatcatgtatggtctgtaagtgtttgtgtacgtaagttttttgataaattttagctttttattttttatttatttttagagacagggtcttgctttgttgcccactctggtctcaaactcctaggacttcaagcaatcctgctgactcggcctcccaaagtgctagaattacaggcatgagctagtatgcccggccaattttaactttttatacttttttaaatatttcttttctttctctttttttttttttgagatgaagtctcgctctgttgtccaggctggagagcagtggtgcaatttcggctcactgcaacctccacctcccaggttcaagcaattcccctgcctcagcctcctgagtagctgagattacaggcgcacaccaccatacccggctaatttttgtatttttagtagagatggggtttcaccatgttgaccaggctagtctcgaactcttgacctcccgccccacttcggccacccaaagtgctgggattataggcatgaaccactgtgcctggccatttttttttttttttaatatttctaggctatgcagtttgggagttttttcaaattgtcacagatctccaaaaaactttctaacatgtttattgaaaaaaacctgcatatgtacagttcaagctcttgtttaagagccaactataatttcatgggtatttcaggaatgctcaaccaaaattatattcttatctgtactattaatcatataaaatgtcttacgcattttagtgttcttgtgtattttatataaaatactgttttattgttgttgtaggggcaatgttaaatattgttcaagattcagcacttttggaagccattggttgccagatggagatggtaagaagcatacatgcaatctgtcagagaatatcacttttgaatttcatgtaaattatattccagaatgtccatctttgtgaattttaaaggcctttggtttgtaaatcctgctcattggctcagaagttttctttttaaaaataatgtatattttgaggtttgcttttcagtgcctcttcagctgtacatcaggttcccgagatattctgtatgagagaaactacagctaaatccagtctttattcctgaacagtgtctgcttaaaactgttacttgttttgctgtggtggcaaacttggttgaataacctaggaaaagccctagccagcaagcaactagtttaactttttcttacccatcaattctttctaacccctctagacctaagtttgcaggtccctcaaagcaccaatgcttccaaatcaaaaatgcttctcagagacttccagtgctctctgctttgtcttcaagatatatcatccctatacttggagtataggcaagacaatggaggggttaatagggtatactggggtaagttgggtagatgtagtaagctgagtagatgtaagatgggtgatcaaattattattacggaaattacattcgtgtctcagtagatggtgaataataatttactgatctgaatataatgaactgtgtttatatggggaaaaatgagggaagtctaacagataggtttattagcccctatacatacgggagttaaaactaaccctagtattgtttgtgttttctgatataactgtatttgaaagttgccgtttgtttattcatgcctttttgttttttgttttgttttgttttgctttggttttgagacagagtctcgctctgactcccaggcttgagtgcagtggcgcaatctctgctcgctgcaaactccgcctcccaggttcctgccattcttctgcctcagcctcccgagtagctgggactacaggcgcctgccactgcgcccggctaatttttttgtattttttaatagagatggggtttcactgtgttagccaggatggtctcgatctcctgacctcgtgatccgcctgcctcggcctcccaaagtgccgggattacaggtgtgagccagcgcgcctggccttattcatgctttttaagcttatatttctgttctgaggttttgcttgggaggcactagggtattctttttaaggacctggaatctagtgaagtctagtaaagatgaaaaagctgggccagccctttgtaaatagtggcaaagaagaccccagtatgggcacttgtagtagtacaaatccttcataccctccagtagatttgtgtgtgtaaaaataccacagtggttttaatcccttgtcaatttctgttactatcagtttgtactattcagttggcacattctgctttatcaacatggtttttaatgattgacctttatttatgcttgtaaactgtgatgtaatcctcacttgattcattttcatttgactagggtggtggagaaaataacctgaagagtcatagtcgcaccaatagtggtattagttcagcaagtggtggaagcacggagcccacgactcccgatagtgagagacctgctcaagctctcttaagagattatggttagtcgtgtttcttttgaaattcaaagtttaatagaatgactttaatgcttacatttataaaacaaaaacattaaaaatgttaatgttcatgttttttatatacttaagtataatagagaggatgtcagtcttaagaagctaagaaaaaacaaatctttttgatttagctgtatagcttttgggtagtatattagatttggggtagtatattaggttttataattgatagtaatgggtgatcagtaaacatttctgaattctctaccatgtgtggtggtagagaaccaaataagatgtggactctgcctcagagctcacagtgtagtggcagagatgtccaataagccagttattgcagtgtggcaaggagggtaatgggggatggattagatagcagcccagaggagagcatgtcttcatgttaaaacctgtgtaccccctactgtagctcactagattctttagccctgaaacatttttattttctgccctgccaagtaaaacatttgccagccaagcatcctatacaaggttgtcccctaccttgggcagttgttttatggattctgtgagtttgtgggtacctttatgtttttctacacaagtactaacagtgtattaaatctgtgagcacttatccagctagattggagtgatatctagattcttagatgtgagtttaatcctttaatcatctggagagttcatgagccatgttcatgaggttcatgaggcatgtcatgagccatgttcatgagttcatgaattcatgaggcatgtttctatggtttaagtttgcaacaagtatccttgaacatgtcagatatacataaagccattatgtggatatttgacacatttaaatattatattcgtgaagaagttatttaaattatcttattcactgtgtatgtagatttaggtattctataggttgaaaattatttttcatgctttctgaaacacatttaagctaaataaatttttcagtactggctgggcgcagtggctcactcctgtaatcccagcactttgggaggccaaggtgggcggatcacctgaggtcaggagttcgagaccagcctggccaacgtggtgaaaccccatctctactaaaaatacaaaaattagctgggggtgggggtgggtgcctgtaatcccagttactctggaggccaaggtaggagactctcttgaacctgggaggcagaggttgcagtgagccaagattgcgccactgtactccagcctgggcaacagagcgagactccatctcaaaaaaaaaaaaaaaaaacagaaaacaaaaacaaaaaaagaaatttttcattactgcatgtgttctaatataaatgttttaagtgattattgtttgtttcagcattttgagctggtgttagtgagctctgcttgtaatgtcgtaaaatattttttactaagaaatcctgatttgtgttagtgtcgcatgagtgtctctctttaatgatcattcctttttctgttgtcactgccctctttctgataggatcgacaggtataatgtccctaaagcttcctttataaattcagtttaatttgtctttatttaatttttcctaatttcctattagctaactagtgattgcttttacatatagattggagcccaaataaaaatatggtggcttggttatttaatttttttagaagtattaaagtaatcctggagaattaaatgttaaagtatgtttgaaaaggcattgcatgtgagttttgatggcttaaaccctgtaagtaatttcaacagatgcttgcttcagagtaattcctagcatctgaggaggccgtaaaattagaactttcctctgtaaagtttcaaggaaataattgatagccttttcatcactctttttgaaaatgtagctatgagttgataatttagaaactttaaattacgttgttatgaaaatgacactgaaactgccaaatcccacggttgtgtcaaagtgcgtgaaccaggaactagaagctgctctggtctagcacatgtgcctgtgcaccgtgtagtcaggcttggcactcaacccagtggggtggggagcgtagcactgtgtgggtgcccgtcgttctcactgtggctgctgtggtctgtgcctagtggatgctgtgcttctcgttactaatgcttagttgttttccctccctgtgggatgtggcattggggttatatcctagctcttaatacagattcagctgctgggctcctgattcgcagcattcatctcgtcacccaaagactcaactcccagtggcgccaagacatgagcatatcactggcagctctagagctcctctctggccttgcaaaggtgaggaagacagtccttttattttaacccaacagccttgggccttggctgttttttctgtatctcttaaccccttgtgtgggtattttagtgttgatcatgctcaaacatagtttatattatatccaaagtgtacaaaatttagcctccaagtgatattctatgcaatgaactttactttttaaaaataggttcaaagagtatgaatgagatttttaccgttaaattataggaaacatttcaatacttgccatttatttatttgcatataatactagaatgcatattgattttgtaaaaaatgattatcctaatgtatgccatttgggattacctgtggctctgccatcctccattatcagagataagtgaaaactggctacacctttttttttttttttttgagacggagtcttgctctgtcgcccagtctgtagcgtagtcgtgcaaacttgttgcactgcagcctccgcttccaagcaatccccctgcctcagcctccaactagctgggattacaggcatacgccatcacagccagctaatttttgtgtttttagtagagatggggtttcaccatgttggccaggctgatctcgaacttctgacctcaggtgatccacccgccttggcctcccaaagtgctaggattccaggtgtgagctactgcacctggccttggctacactttttagatttctttcccagccgttacttcagttttttggaaacttagaacttggtggtcatttgtgcttctctaagtgtattcttttgagatgaaatttgtgtaatataaaattagccatttaaaagcaaacaattcagtgactgttggtacattcacaatgttgagcaacttctacttctagttccaaaatgtttttatcatccctaaaggaaaccccatacccatgaagcagttttgcttcagtctccgcaccccctcctctgacaaccaccatttcatctcaatgggtctacctatactggacatttcatataaatggaatcatacaatgtgtgaccttttgtgtctggtttctttcactaaatgtaatgtttttgagtttcatttatgttgtagaatgtgtcagaactgtattcccttttatgattggataatatttcattgtgtgtatataccccagtttacccatttatcacttgatggacatttgggttgttttaatctctaggctgttgtcagtagtgctgctgtgaacatgtatgtacatgtatttgtttgaataccagttttcagttcttcgggtgtacactaggagcagaattactgggtcatatggtaaccctatgtttaactttttgaggaactgccaaactgtttttcacagtgactgaatcattttacattcccagtgtatgagagtttcactttctttgcattttctctaacatctaggtgttttcttgacagtaagatgagcaggattatcttacatataatatataattgaggaaatacgtaaaatattttgtgaacaaagagccgataaccaggtgctactgtctgggatgatatggttcaaatccttatttttcagttatgggaatagttgtcagaggctgtgacttacctaagctgtaagaaacaaaataagcaataaaacctaaggtgttcttaccaccacttagagcttacctcaaagatcctccaggatggacatcataactttgcgagaagcagttactggtacagaaaataaaaaacagccatttgtgagacatacaggaccacactgtctttgagagcaaggtactgtttcctgtgacctttagtacactcagtagtaagcaataattagtcctaaatggagcactgctctggacctgcctaacaattcataaagggctaacactacctgatttgatgatttactgtaaggctacagtaacacaacagcctggtattggcataggggtggacaaattgatcggtggaagaaaatagtatatccatacttaagtggtcatctgatttttgacaaaggtgcaaaggtaattcaaaggagaaagggtggtcttttcaaccagaggtactataaaacaattggatagtcatacacacaaaaaaaagccaaaaaattttgattcataccttgcactatgaacaaaaattaactcaaactggctgggcatggtgactcatgcctataatcccagcactttgggaggctgaggcaggaagagaccagtctgggcaacatagtgagactttgtctctattacataaaaatatatatataaaacctaaacaataaaacttctagaagaaaacaagagaaaatctttgtgaccttgggatagatttcttaggtgttacgctagaagaacaaactgatatgttggacttcaaaatttaaaactgctgttctttagtaaacactgttaaaagaatgagatgacagatcacaggctgggaggaaatgtttataaagcatatatttgatgaaagatttgtattcagattacataaagaactctcaggactcaataatagcctttccttttggtggtgcacagcagcaatatggtggtgaaaatttctaagaagaggaagtttgatagcatcttcagaaataaactgagcgaattcttcactcagaagcttgcagaaggtgactactctggagctgaggtccaagttatgccaaccaggatagaaatcactaccttagcctccaggatgcagagtgttcttggtgaaaagaaccaccggatctatgaattggctgagatagttcagaagaggtttggcttccttgagggcagggaaagctttatgctgaaaaggtggcctaaaataattctctatgccattgcccagacagagtctgtgctgtaaactactattagggtttgctgtgaggagagccttctgtagtgtgctgtggttcattatggagagtggggcaagagctacgaggtcatggtgtcagcgaaactctaaggacagagaactgaattcatgaacttttgtgtgtgatctgatgatccacagcagagaccttgttaactactgcattgatactgccatccaccatgtgctgctaagacagggtgtgctgggcatcaaagtgaagctcatgcgtcctgggcccaagtggtaagattggccttaagaatcccctgcctgaccacgtgagcactgtagaccctaaagatgagatactattcgccatgcccatctcaggacagatggttaggaagccatgctctacccagccccaactgtgtaatagggtctccttggcagctggatctggagtctggatgttgccttgtaaagacctttaataaaatcttttaagacaacaaaacacaacaacaaaagcccttaataatacaacaaacaacccaattaaaaattgggcaaaagatttgaatagatgttttatcagagatgatatacagatgacaaataagcacatgaaaaaaatactcaatatcattaattattagggaaattcaattaaaaccatgatgagataccactgcaaatctattagaatggctgaaatataaaagactggtcataccaaatgttggtgaggatgtggaggaactattgacgagaatgttaaatggagccaccattttggaaaacagcttggctgttccttaaaaaggtaagcatacacctacatatgacccaataattccactcctaggagataagagaacatttatcgatataaataccttgtacatgaatgtttatagcagctgtatttataatatccagaagctggaaacaacccaatgtccattaataagtaactagataaattgtggtatatccatgcagtggactactattcagcaatagaaatgaatgaacaattgatacacccaaaagtgtagctaagtctgaaaataactatgctgagtgaaagaaaccagaccaaaaaaagtacatattgtatgatctttatatgactttatttatttaaactctagaaaatgcaagctaatctatcgtgacagcagatcagcagttgcttagggagaggggcaaagaggagtgggaggaaggattacaaaggtgcatgaagagatttggaggtgatagatacatccgctgtcgattgtggtgatagttcacaggtgcatacttatgtcagaattgaccagttgtatacttgaaatattgggcaatttatgacaattatgcctctgagcagctgcacagaactttctgcagagcctagtgcatcactgtgaggttgggttaggggtttaaaaatgtgcccatgttctttcagtctctgggaatgatgaacaggtatacccaatgggtttgggttttagggcatgaaaaactatgctaatgaaatactgtttgagcacttgaaaaatgccactattttttgtggagtattacaatacatctgaaataatctgttcctgtatataaataatataaaaaagcaaggcttcctgtagtgtatgacattgtcaaataggtcaagcttcagtgcaaatgctttgaaattggtacagtaattcctggctgattgtttttgttctccaaatgaatatgctcaggtaaaagtgatggttgactcaggagaccggaagcgagccatcagttctgtgtgcacctacattgtttatcagtgtagtcggccagctcctttacactccagggatctgcactccatgatagtggcagcttttcagtgtctctgtgtctggctgacagagcaccctgatatgcttgatgaaaaggtgagtttattttattttaaaccattaagtaaaaacaaaaatgtatgctagcaaaatgccttttgaaagagaatatctaaatttaaatacagtattgcacactttaaactgaaaatacttgttagattacagtggaacacttgtccttttgggtacaacttgaaaactgtcattttgcttatatttggttgcaaattaactcatagagaaattgtttagaaagatgagaccttggctaatttatctgagctatcaagattgttctttcttgaaaggatggtagcctggagatagctagtaggcactttggtcacccttcaccaaacaaagaagggcagatgattgccaggctgcaaacctagagcacagctcatctataaaggttgcttctatcgaaaaatgttactccatactcatttcttcattctcaagtggatgcagataactagtccatgttccctaccattgttctgtgtaatgtcttccttatagggaagcaggtgttataaggaattcacagtgcaaatcaaaggagagatcattggatatttatagaaacctttatgtagtttaaggaataatattgttgattaaatcttagtcattttcattatggcttctgaagttgtaataccagaaattacttaaaaatgtcaatgacaagatttcctttggatattataatatgtcttaaaccatccccctcctttgatagctaagtccagagatggtgtctgtctctctgtggttacactatcccaagcttaactgaattactatttaatctcttagatttgtgcttttgtgatttatagtcttcagtaatttcacaagaaagttgaattgaatttatttatctaacactctaaacaccaaaatttagttctttaatgagaaattggggggagggggtgtaaagtttattatattactatgaagttaatatatatccattaaagaaattaccaagaaactggagcccttccaccaaaacgcaaccactgttagcatttggatggatttccttgtcttctcatgagaaaggtgtgttctaaaaattgatctgcctttcctgcttttaggactgccttaaggaagtactggagattgtggaactgggtatctcaggaagtaagtccaagaacaatgagcaagaggtcaagtacaaaggagataaggagccaaaccctgcatctatgagggtaaaggatgctgctgaagccaccctaacatggtatggaagtgaccgcacagggattgtgcctaggaattagatggggttagcagtgatccatgttgtttcatttccttcctgattgttcagcattgcgtgatgcagcccctttagaatatactttttctccagaaataaaatgggaagaaaatctctattttttttttacgtgttttgtagaccaaaagaaactaggaacttggggttgagagtttgagtcctttttctataccgtttgatgttaattcaagtaatactgtgttagagctagacttactgtaccccctcactttgatagctaagtccagagatggtgtctgtctctctgtggttacactgttagatctgctttccagctcagtggtctgtattctctgctataccatttatattacatagtataggttcattcaaccaagatttatgaactctcttaacaactgagaataggatcttaaagataagtctgatttagtcaccactacgtctaccatcttgtctggtagggaagataaaatatgaacacaaatagctataatattaggtggaaaataagtgctgcaaaagaggtataaataaaatgctggggagttgaaaggagaaaatgaatacttccagataaggggaagtcagagtaacatttcttgaggaaaatgacactggacctgactctgggaggatgggtcaagtttgagctgcaagccagagtacagggtgggtaaaaaggcaccacgactgctgttttgagaattttggtgtagtaaagtggtaaagacagggagtttggtaccttgaaaaagagtagcagagaaagttgagagagtttttgtttggcttgtaagtgagcatactggaaagagggaaggaaggcagcttagccacatttgtggactgaatggaacagttagtggaaattaggtggaaccatagtacacgtggaaagatggggcttatgaaaggatatgtgcagatgaaggctcagaaaatgtaaaagcagaaaggaggagtggcaagttagtgtgggctggggcatcttggtcttagtaaagtagcaggcaaaaccgcttgaaaattcgtgtgtaagtcagcccttaccaagatcccagcatcttctgtgagttcagtggcctgttgcttgcttgggacatgcacagtgaagttggatttgtttctattcctgtgggcttaagtcattcagtgaatttttagaagaatgctttctgtcatttagtcctgctcactatgcaaatgctggactttcggtgacttgatggaggtttggctaatagctagaaaattaaaaaaaaatgtgaatacagctactgaagcatgtgcttatgctgatgatgaatactagaagtaatataagttcagaaagaagaccatgtgtgggccagggtacccttaaaagtgtcatagggctgggcgcagtggctgcactttgggaggccgaggcgggtggatcacagggtcaagagatcgagacctcctggccagcatggtgaaaccccacctctactaaaaatacaaaaattagctgagtgtgatggtgcacacatgtagtcccagctactcaggaggctgaggcaggagaatcgcttgaacccaggacacggaggttgcagtgagccgagatcacaccatcctggcaacagagtgagattccatctcagaaaaaaaaaagtgtcatagaactaaaacttgatgcatgtcttaaagagtaagaaggatatggagagaaaggaggggacatttctcactagaaactcttcattatacaaaaataagcttgctccatcctagcctggatggggtgttctttgagtgcatggctagcagtgaggattggatatgtgctcagggtgagtagagtcttgggatgcttcttctcaacctcaccagtaagctacatggctcatctgtttcgcttcagctgtcttgtctctgctagcagcttgacaaatggtatctccagttttcagtcttaactgtcatcatgaaacgtgtctctaaccagatttctctgttctctcacaattgctgctttatgttagtatcattgctgtttgccagttatgcaaacacagaactttggctgtttctctgatttatctttctgtcattccccatgtacatgagccagtgactgagttaaacagactttatttttgtaaagtatttcctccatcccctccaacctggatagcatcctagtccaggccctcctcacttcttgcccaattgccctattttcgatctcttagcccttcttgttcattttgtattctattgcaaaactcatcatccttaagcacaattttgatcctgctgcttgaatgattgaaaaccttgagtagatctgtttccttccttgttgtctaaactcctcaatctggtttttaagggcaccatctgatcttttccaccactgctttgcaacttgtctgttttgccgttgtcaggcctgacagagcactgtggctatgaactagccatgcttatacctgcttatgctcttcccctgggtttcaggacctcttttttcttcacttggctacatcctccgctgttcagtgcttatagcaaatctatctacctccatggggcctttggttattctgcttctgaagatgactcttttctgtacttccgtgctcattctgtctgaccctgctgcacggcatggagttttatactgtcatgattgtacctggttacatgtgatccgtgctagtgttgtctcgccagtctggggagcacatttacctctttgccaacacagtgctgaacacgtagtagaaaattatggagtgcagattagctggttaggttttttttcctctctgtgtacactaatacaaattcaggattagggctcttggaagtcatttcaacagtccctttgcctgtcacctttaagacatgtgtaccaagttatttagcctctaatttggagattttctaacccccaaggttgcccatttcattttaattgttaaaaacttgatactttacattgagctaaaatctctcccacttctatgcgttggttctaattcatacatttgatcgttaaatcctttttgtccaggcagtagcagtatccagaagcagtcttcatgttctctctggttcatttctgctgttaccttcagttttttttttttttaaatattacaaagattcaagtacctttatcatcctggttattctcaactggcatagatttgactatgagcctcttacaggtggtttacagagtataatactctattattttgtatttttttcttgagacggagtctcgccctgtcacccaggctggagtgcaatggcatgatcttgactcactgcaactgccgcctcccagagtcaagcaattctcctccctcagcttcccgagtacctgggactacaggcacgtgccactacaccctgctaatttttgtatttttagtagagacggagttttgccatgttggccaagctggtcttgaactcctgacctcaggtgatccatccacctcggcctcccaaagtgctgggattacaggtgtgagccttctgcacccagctgagtacagtattctagatatgatttgatgatctttaaactctatataatactacattttcattaaaatgtactcggactgcattgcatttttgagaacttgatgatttgcattaagtcaactaaaatccttgagttttttttcacacgtttacctttcatgtgtttttctcatcctgacttgtttgggagtgtttgaaagtaatgcacagaactttacatttaaacctgaaatttcttcatctaagatttacctcattatttttagtctttaagattcttttggatctcaactctttctatggtatattatctctgcagctctgcttttgggcaactggacatttaatgagcatatcctgtgtgttctaaataccttgataaaaatattgaacagatagactcgcaaagcacatcatcagagcacttccttcaggtccacagggatttttaaatttagctacaagttcatgatattatatgaaatgttatttcatataatatgaaatgggaataataatggtatatgggaataatagtggtacctattgttaggatattatgtgaattgttgtgatattatgatactatatcacataatattataacaatcctatcagataggtaccattattcccattttataatgaaggaactgtagcacagaaagaaaatatcttaaaatgaagattttatcttgtggttctaatatcatctggcccttcatatgcatctcaatgggaagaccagtattctacagcaccacatttgtcatctcaactctcagcttgaatggcctctcctctttcactctaaggtttgaacctaaagctctctaacaatggagagcaacattgctcaacagattatttttcttccatttcctctcctcctaaaacgaagactgtctcagaacttcagggaccaggagaacttggcattaagttcaggcctctaatggtttgcagaaaataggagaaacaccaggagatcaataatgagaaaatatggcttttaaacaccaggagatcaataatgagaaaatatggctttggttttctaaaatgggatagagacggttgtcacaaagcatatggaatatgagcttgctgtgttccatgcaagattctaagatatcagataggttgctggtaagggagtaggtcactaagatcaaattataccagcctaactgcattttctgttccggatattgaccagactggaaaggcagattaaatgtctctgaaataaagacatacaggtatgcatctggggtaatgggctttttaatcttggaggggagagtctggacagcatgccatggcattcaccacaaggagtaaatctgacctgtcaagaagcatggctgtggtcaattaaaattcagaagagtggaaggggacacattgatgcacaaggtaaactgaagattttgctttgggaattaactgttatcttttccattctccatagcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagagtaagtttatagtactttgagccttctctactgcttaatcagtgttaccagtaccatgaagctgtttccaggatcagggaaggacagcctacagattctaagtaggtcagaaagatttctagctgtgggacaatagcacctgaaaaataggggggcaaaaaaatagaatatacatattacatagagtcttttaaaggctcttgatgtgcatctgaactagctctgtagttttataaaaggtggtgttttagtgggttccattgtgttgtttatctttgtcactttttcttcccccttgaacttcggatcctgcccctctgctcccctccctctcactcctcatgttctgtatcaattgttggtgctacctacacaggctagaaacttgaggagttatctttacctgccccttcctgttactcacttatataattagtttctaagtttccatcttcccagggacccttgaatttttcctttcctctgtattttcccaatacatccaagtgcaggtccttattatttctcacctagattattacagctgtttcctacctactctgattccctcaacccctaaaccccttgccagttctaacatgtgttttccctactttcatcctacttgctgccaccatagtattcatcttcaaccacaaatgaccatgccagtgccctactgaaaatccttcagtgattttccattaacacaacatgcactgttttcctcctttccctccccctcagttataagccatctcacaatatgtgattatcactgcgacccaaactatccacaagtacattttttttttctgatggtaattggcatcagccagtatgtaaaagaagcatgttctcagacccttattgctgggaaggggaaggaaagtgaaggttacagaatctgtgggtataaagtgacccatggagtcacctggtatacaattcccttagttatgagtgaaaaaactcaggctcacagagggtatatgacttgcccagggttacttgggactagagcccagattttctaaaccctgtattgtccctttctattattattgtcgcacagtgataggatttgctcagtgattaaagatttgccttcttgcctttgtaaaggtgaagagttctgtgccagttttgttgattatatgagtaagagctcataaatccatgaagtgaaagtgagacatttccctgcagtttgagatgaaaagaataccatcataaacttctgttgtgttgtggtgagatgcggtgacattaatgtgaaatggaatggtgccttttattattgtctaacttcagaactgctactcccaagtcttttctacaggcatctcatccttctctaccctagacatggagcttgcttggctttctttcctagcctgtgcctgttcatgattcctccagcctcctactccaagccatctgctgaggagtctgcaaaatcccagtgtccccttcaggcttcctggcctttttccagctttttaaagactctcctactttcattccaaataatttcattgcataggaagtgtaccaaaaatacaagcaattggaattgtatagatttacaaggacattttaatagtttattgtaataataagaaattatagagaagtttgaaggcgtttgactcccatatctgagacggaagaataaaaaaaaggatctgggtcactcgggaagtccatcctgagtgttttttttaacacccccatcatgtccctgaacttctgctgagatggaacagtgcctgcctgtggtgggcagtggtacacaaaggcatgggcagatataacactaacactgcaaacacccagtctgtctttctacacttaagttgttcccaacattgggaggttaagagtatttactaggacagtgtttcccacaaatgtgtacatgtaccattggaggtatgtgagatgatcttagttgatacattagtgaacattattttatgtatttttaagcatgtgctttaaaattatataattagtacatgccaaaattcatgattttccatttagagatgcacaagagtggttgatacaaagtaatagtacttacagtacacgggtatgggtacggcagaaaccacagaagtggtacacaaaagatcaaagcttaggaaacactgttgggcctttgattatgagaagctctgcagttgataacaagtttattttaaatggttgttgtctgaaattaaaacttttatatacatattttattctagatgattttttcccctctgtcactgtgctggtccggggaatgtctggaagacttgcttgggcacaacagctttgtcttttacccagaggagcaaaagcaaatcagaaggtattcatcagaagttacagggaagtgtgtgtgtgttttgtaatttaaaggttaggtaacattccaacagaagacacagatcaaataaatatttttgatccctagccagattctcagtcagtgggttcatatcagaatcatctaggaacctagaattccagatgtactcaattactctttaaagacatgttcaaggcaggtgtcttttcaaaaagctttccaggtgattctgacatctacttaggagtaattgctgttgtggacaatggccccagttttttccatgtaattttacaaatgtaataaaagtcagatatataccatacgtgaaaaaaatttggtgggacttttgatttgtccgcaacaggacttagtttgaaattgttttatatgatttgttcttatataataattggtaatatattgtataaattttattttttttataaagagtcagggtcttgttctgttgcccagactggagtgcagtggtgtaatcatagctcactgcagcctcaagctcctgggctccagtgatcctcttgcctcatcctcctgagtagctgagactgtaggcacatgccatggcacccagctcatttttaaaattttttgtagagatagggtcttgctttgttgcccaggctgatcccaaacttctgtcttcaagtgatcttcccacctcagcttcccaaagtgttaggattacagatgtgagctgtcacacccagcctaattaaaaaaaaaaaaaaaaatatatatatatatacacacacacacacatacatatacacacacacacacacatatgtatgctgtgtataatttaatgaaatcttttggggtgcagtttattttattacatttgtaattatgtgaataatacttgagaagttggaaaaattcagataacgaagaaattttaaatcacctttactcactatccagaggaatataaccactgctaatattttattggatttccttccctttttttcttttcatacacaataacacttgaatagaatttgagtcattttgtatactgctcttttcatttataacattgtaagcttttatttctgctattaaaaatataaaatgtccaacaatgatagactggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccgcatattctcactcataggtgggaattgaacagtgggaacacatggacacaggagggggaacatcacactctggggcctgttgtcgggtagggggagtggggagggatagcaatgggagatatacctaatgctagatgacgagttagtgggtgcagcgcaccagcatgtcacatgtatacatatttaactaacctgcacattatgcacatgtaccctaaaacttaaagtatcataataaaaaaatgtgattaaaaaaaatttaaaatgtgacttaatatttcactagcatttgagagacaccacaaaattggagcatgtgcctaaaatcatttaatatcttagatgtctctgttagatgtgatgtgtttatcacccagtcctccatttttttggagggggcagtacagagcacatcctgtcatcaactctgtaagccagtaagttagcattgaagactgaagaggaaggggaccaggaaaggagctaaaatttgtttagggttcaccatgtacccatatacatattaaagcatggatttggagctgtgaagacctagatttggtgcccatactctcaattaagccgtattaagattcttgttaaaatcactttctagagatgcccagtgaagccaaacttgtctttaattatattgaatgatgtgagagcccctggggaagagagtttgagtcttaaagctccaaaatgctatacccattggataaccactgaatgtgggagattcaggcctgcagcagtagaggtccacagcccatttgtcagtcattagatctataagaagtcgatgaatatttttagaaaaatagagtacacaggggcacaggctgcttccctttgctgttatctgtagcatttgcaggttctgagtgagtttttgtgacatgtaatcctagggaaacacaggcatctaagagaccagggaaatacatgtcattacagatgggtattggaccctgtgtaataaacataatgttacttgttttaacagctttttgtacctgaacctcgcccagttcctaaaaatgacgttggatttaaatattctgtgaaacatcggccatttcctgaagaggtggacaagattccttttgtgaaagcagatctcagcattccagatttgcatgaaatagtcactgaagaagtaagtacattatttttagctgttgtcaaggggatgaatagaaacattcttacgacttccttggtcaagacaatgcttttagtgttgttggagatgatttttaagatgacatgggcctccatcatccaggaggttgccatgtttaagacgaatatagattgtggctgatcgaaaggaactgcatatctcttagaggtgttgctgggctgcctggctgttcgtggtaggtttcagtactgtagtgacatgatcagactctggtagtagagttatttggaaaaggaagaccagttcagagactattatgagaatctaagtctttataagaaaggaaggactatttcactcatatggaattttaatatataaaatgtattgtggaggtagatccaagcagtcttgaattggtgagggaaggaaaagagccaaagaatttcagattttgagcttgagtgacaaagagatatcagtgccatttacagaaatgcagacattaggaagaggatagatttgggaagatgggaaaaatttatttggctttggattaatttagagagttaattaagataactgtctcttaggtcaagggagaagaattttaagaagtcggggacagaagtatgtcaggacatgagagaacagaagagcaggaatggaggaagggctacactctccaatgctggagagaccagggagaagaaggaatagaaaaagtcccctgaattttggcatgaaatttaggtgacctttgagaacaggtgtgtacagtaggagggataattcaaagggctggggagtgaatgtattgagggacaggcagtgaatagaaactacactgttaacagtaaaggcaagggtacagaatgggtaatattatagcttaaggaaatggcctcgttaaggaaagaaaaggctgatttttttttttttttctgagatggagtttcgctcttgttgcccagactagagtacagttgtgcattctcagctcactgcaatctccgcctcccgggttcaagtgattctcctacctcagcctcccaagtagctgtgattacaggcgcatgccaccatgcctggccaatttttgtatttttagtagagacgggatttcaccatgttggccaagccggtctcgaactcctgacctcaggtgatccaccctcctttgcctcccctcaaagtgctgagaattacaggtgtaagccatcgcacccggccagaaaaggctagtttttaaatatttttttacattcaaggatgtgaggattatgaacatgcttatagattgaaaggaagaaaccagtagagaggagtctggctaacactgtaagatgggcagtgggacttacaagtaatagaggcagtagggtcaagagtctagtctagaaaagagatgcttctaagacagaaggagagagtaggtgaaggttcagagacatttagagaggaaaggagggaaattgaagaagtttatgaaaattttaatcctggttcttggcagtgtaataggggatcccagacagttcttaagaattgccaggcagtgcagctgaggttaagtagcattatctatagtgaagttatttaactcactctgctgactttcttcaaaagtccttgggatctggaagcataagtaaagaatttgactggtgtggagattgacaggtgtggaaatttggaaggaggttcaacacagccatttaatgtgcttaaggagagggtatttagctgttagatgtgggggcttcagtttagttgggaagcagataaagccagaaggatgctaatggagtgggaaagcagggggagggattgagtgccccaccgcaatagtagagcacgagctcaggaagtgaagggataggagttgcacaagggggcttatgattggagagggaatttcagacttacagccctggaaagcagggcacatatcaggttcaagtttgttttcatggatggccaaaattgtgaaggttgaggagcttgtagaattctgagccaggttgttagaaggatcgttactcacccgggaatggaactttaaacaaggattgatcagaaggaaaggtgggagaagtctctaagagtacagtcatgtcatccatacagatgaggaattaaacacagggagcacgtcagggtgaagatggacagtgatctgcaagcgaggggtgagagtgacaactctgccccctttcttgcctatttgaagggaaccagagactgaatgttttcatttacagtgaaaacatgaaggagcaattgttgaaggtatagggaagtttttttggcatttgttttaaccttggaccatgtttgcttaatggcatactctacattgaactgaatcacaatgttgatcactgaaaattatcttcattttctttgttgcttgtagctttattttcattttaaaattaagattgacttagctaggtgcagtggggctcatgcctgtaatcccagcactttgggagcctaaggcaggaggatcacttgagcccaggagttcaagaccagcttggtcaacatagagcccagtctcaaaaaaaaaaaaaaaaaaaaaaaacacttaagattggccttactagtttgataatagtttcaaaaaatgaaatatttggtttattacagttagaagagagacacgaaaaattaaggagtggcatggcccagcagattgcttatgaaatacaccttgagcaacagagtgaggaggaattgcagaagagaagttttcctgacccagttacggattgcaagcccccgcctcctgcccaggaattccaaacagcccgcctttttctctcacactttggatttttgtccttagaagcactgaaggtaattttcatgaacttttatgaataaatatattcacaagttaacattcagctgacaatagctaaaatatttttatcaggatagaagcgaattaaaaaaaaaaaaaactggttaaaattttagcctgcatacaaataaatgaaattctgtgctgctgtaggttatagtttgtgctccaggacaggtcaccccatgaatgcattcagagttctgtctgaggggactggtttgatgatacatctaactctgaattttcctagataacacagtacccatattacacagataaatgaaatctatagataattagaagaagaatgttaaaaatcttcccctagtaagcattattactaaaaatataagctacaattaactttgctctttcatgccacttttagaaaagaatgaagttaatactgtagtatttgtaagtcaagcacttcttatgttgtccagtttgtaagatcaaactgtctggctttatgtcctggaatcactgcttgccagctatgtggtctttggtgagtttctcatcttgtcttagttcctcatcatctataaagtgaggatgataaaagtatccatctcattgatcatgtgaagattaaatgtgttaactcatagaagatacttggtatagtacttagcacaaagtaagccagcctataagataaatattgctattattcttaattccattagccttaaaacaattttacagccaggtgcggtggcttatgcctataatcccaacactttgggagcccaaggcaggaggatcacatgaggccaggagttcgagaccagtctgggcaacatagcgagacccccccatctctatgaaaaattgtttttaaaaattagctggatgtggtggcacacctataatactagcttctcaggagtctgaggcaagaggattgcttgagcctgagagttcgaggttacagtgagttatggtcactccactccactccagcctggttgacagagtgagaccctgtctcttgggaaaaaaaaatgtacaagacaagtgatgcaattcctgttttatagatgtggacatagaggcttaaatatgtgaaataacttgtctggaggtggacttggaatttactctaagtcctgtttgttttgaaaagtacaactgaagattgccaagcaagaagttgcttattgcataacttgtcccttgcccttactgcctaggaactacctggttataggccatttagctttgtaggaaagtaatggggacattgctgtttgattttgtatttcagcatgtagcgggaaaattttttttgtatttttgtattttttttgtagaaaattgagtttgatgcagcatatgaacataaaaacttaaaatgcagaataaaagagcagagagaggaaaattataagaaacatagtggtaaatatggaaggcaaggaaaaaagacacaacttgcaaatcattagtgatattcctagtggagaaaattgaacagagtagaagcagtaaataaaaatatactagaagaaaattaatgcttcctatggacttcagggacacaagaaaggccctaatagccttgtttctgagattatagttttccacttctgttatctgttctagttgaaacttaagcttttaagaaaataattatcatgctttctcatctgtatgagaacataggaaaaataaagttacctggtttatgaaccttagaatatttctaataacttaaacctgacagctcatacatacagaactacaaaccagttttacttatgaatgtatgtacaaaagtattaaagggaatgctaagcagacttagttctgaattaatagcatgttaagtgaattgttttccatgatcaaataaggtttatcccaggaacttagcaattaattaccaggaaatattaataaagctattaagaaaataatttggtcccattagcagttcagtcagtgaaacagtaagtcagtatttactagaatcatattctgattcttaaaaaaataacaaactaagccagcactactagtgtaggttcttactttaaaagattcctctaatgaaacccaggagcaaactagaggaatcttttgttaaaatcagaggtaaaagttatctatcttgactactatttaacaaagagaattttttagtcaatgacgttttttaaactttctagttttaaataattatagattagcaggaaattgcaaaataaagacatgaggaccttcctgcgatgataaattcttatataactacagtacagtataaaaatgaggaaagtcaatgaaatgttaaactaagaggtaaaaatcattggaaatgagaagacagtttgtaggtagtatgacttctagtttgacaaccgtaagaaaatcaataaaatatttaaaataaatgagacttaaggttgccatacaaaaaagtacaaaaattaatgattatgtctatgatattcagttaaaaatacaatgcaaaaatgccccatttacagctgtgatattgacaaaagttaccttaacaaactatgtacaagacctagaggaagaaacttttaacaattattaagagatataaaatatgtatgagttatgttcctggattagaagatcacacagaagaacaagctgaggaaataccttactttaaaaaaaaaagaagaatggggacattctgatctacaaggtgtattgcaacatgcttcaggtccacagttccttttccatgatttcaacgtaaaaactgaaaactggaaaattttttatatatttgtagtaaattcatttagtggcaaaattggacctgaattgacatgaggctgtttgtagttttatgtcacttagtgtgaatacacttatgtttgactgcagaaatattaatgtcttttattagaatattgccctagaccttgctaggaatgttatgtaattgactagaaggctagactcacaatccttgtcagtgtgaaagacagtcattcttgctttctctggaggatgctttcctgaaagatatactatggttagcaaaaccttgtttggcaagatcaagatctcaaagaagataggggattaagaggaaaacaaaacaaaaatgcatttttgaaaaatgtgtagacttaatttttttagagaagatttaggttttcagaacaattgagcagaaagggtagaaagctgtcatacaccttccccacagcccagtttcccctgttatcaacatcttgcattgatgtggtgcatttgttgtgactgatgaacctgtattggtgcattactcaccgaagtcggtgatttacaatagggttcactctgtgctgtacaggtctctggggtttgacaagtgtataatgacatgtgtctaccatcagttgtacaaatagttttactgccctaaaaatcccctgtactccacctattcatccctccctcttcactcctcactcaacacctagtagccactggtctttgtactgtttctctatagttttacctttttcagaatgtcatatagttggaatcatacagtatgtagtcctgtcacactggcttttttcacttttatcagtatgcatttaaggtttcttcattcagtatgcatttaatgtgtctttttgggttggtggtttatttctttttattgctgagtaatactccattgtatggatgcaccacagttgatttatcccttcatctattgaaagacatcttgattgcttccacgttttggttattatgaataaagctgctataaacatttgtgtgcaggcttttgtgtggatgtttgtgggaaaataccaaggtgtgcagttgctgcattgcatggtaagactgtgtttggctttgtaagaaactgccaaactgtcttccaaagtagctgtaccattttgcatttcaccagtaaggaatgagaaaaaaagtacattaaaagtaagttctagaaagcacaatattatagagaaaactggatccaaaaattatatacacaatataatctcagttgtctttaatttaaaaagaggcaaataaaagaactaaaaggaagtatgttaaatagtttctttagtttaggattatggttgtgtttattcctaccattctatattttttaattttatttttattaaaccatgagcaagtattgtttttataattataacaatgaaagaaaataggtaataattgctcctttcttcttttggtggcaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagaggtaagagttacgaattttttttttttggtatgtttttgtgctataaatacacgtctaaagaaaaaaattgaggcaaaattaatatggagagtttatttgggccagagttgaggactgcagcctgggaagtgctggaaagtgcttccaagaacaaaggagaggctcaagtttttaaagataaaaaggatgagtcaggagagtaggcaattacaaaagttgtttttcaggacttctcattggtttacagaaataacattgattaatgagtggatataaattattgaactgtaggatatgagctatggtgtccagcactgttagattagctaatgaactgttggtggtgacacacagtctagagtccatatagcacgcagcttcaaagtgattacttagctcaagcgggagtgagatgtgactgctatcaaaaaagtgcctttctaggcatgataatttgagggagactcacattccttaaaaagtttcattttcatatacaaaattttacatggtatgcacttgtctatggtaagaagtattttgtacttgatgcctaaagacttgctatgaaccagtttgaaaacagaattaatgaaaactatgatgcttagagtcctgagtcttttgacccttaaggaatgtgatttaaataggagctgtaggatatctttcttccccttaaggaattcagattcacaagacaaaagaaactgaaataacgaaggttagtcataaaagttaaagtaaggctcaagaagaataaaacaatagcaacaaatatttatggaacatcttccctgtggctcagcatcccaggatatagaagtgagtaacagtttcctttttgagaagcagctcaccttcctagtaatttcagaagcaaatcatttcagttgaggaatgcatagtgtgcagtgggagaaataacacctgaaataaaggagaaaaacagaaggactggccgggtgtggtggctcacgcctgtaatcccagcactttgggaggccgaggcggatggatcacccaaggtcaggagttcaagacaagcctggccaacatggtggaaccctgtctctactgaaaatacaaaaattagccagcgtggtggcaggcacctgtagtcccagctgcttgggaggctgaggcaggagaactgcttgaacccgggaagcagaggttgcagtgagccaagattgcaccattgcactccagcctgggcgaagaagtgagactccatctcaaaaacaaaacaaaacagaaggactaagtaaaacatacctggatacgtggaacaaagagactaagagaaggacgaagaaaaatgtaagataggtgagaatggaaaactgagagcaaaatggcaggagacttgaagtgctttttggaaaggaataattgaaatatggaataggcaggaagttactgactgtaactaggaaagagccgaaggaagacttgtaaaatgtcgtattcagatgtgtagggcactgtgactacatgatcctggaattttactgtagtcattttaagacaatcagctaatcaaattagcatgcctaaagaaatttaccaaagtttccaaatgtttacactagaagcactgtttcaaatgatttgtgagctcctagaaaagaacactgatttatgagaaagttttttttttttgttattgagtcaataaagttaagaagtgtctgttgttaggtaccagggttatagtgccgaacaaaatctacaagatttctggccccctaaaactactgcatagaagggaaggcagatgattaaataagcaaacaaccattgtaaagggtgttaatagggtcattaaagcatgttataggagccatagcaggaaaacctaatctggttttaagaaggtggcctggaggaaaagatattctagctggtatttaaggtgtgccttaactgtaggtaaggaggtagaagcagattgtcactgacaaaataataataacgtgtaaattcttcagggtaaagagagcatttcttcatgaatttcattatggggtctaatatgcttggagcttaagagaaggtgggctgggggtagccagagatgagaccgatggagtcaagtgttttagaagaagctcagtaaaattggattaattatggaggtggggatctgttttgcagcaaatcagtgcattgttttgtataagaataatggagccacttttctcctgcctgtacaagaagacacaaacccttgaggcacctcctaacccagttcagtttccttagctttttagaagctgagggtgactaggaattaatgaagatttcctgagatctcctttggaatgtctaagacctgccttccctagccgtagggtagattaagattaatttctgtctgccagcaagtggcatgaaagttgaatttgattcacttactgcttcttgactaaattttcaaaaattgtttatttaaaagttttacttctagataaaaatttgaattgcaaaaactagaaatggttgttaagtcagtttcttggcgtccataagaatgtgaagggatatgggtaaactaaataggttcacttcaaaagagactggttttaggccgggtgtggtggctcatgcctgtaatcccagcacttgggaggccgaggcgcgcggatcacgaggtcaggagatcgagaccatcctggctaacatggtaaaacccgtttttactaaaaatacaaaaaaattagctgggtgtggtggcgggagcctgtagtccagctgctcgggtggctgaggcaggagaatggcgtgaacccgggaggtggagcttgcagtgagcagagattgcgccactgcactccagcctgggcgacagagcaagactccgtctcaaaagaaaagaaaaaatagtctggttttgtgtttaagaggtaatgaccttgagatgatttgcagtgggtcagatgtaatgaatgtaacttcctatattttgactttcacaggcctctgtatgatcttggtatagattagcattgtatgaatgacatcagtgatttgtggactggctgcatcacagtcatttggaggaatttttagaaatagtgattccaggattccgccttcactgattttaatgtagaaggtctagagcaggcgaagagaaccttatttttaggagatttcccagatgattttgatatactctgctctctaccctcccccttttatttttcatttgcaagggaatttcttagtttccttcctttaaaagtgagtttttcaagagcagcactattgccatcttgggccagataagttctttgttacgggggctatcctgtgtattttagaacatttagcagcatctttggcctctaccactagatatttgtagtgtgcctcaccagttatgacaaccaaaaatgtctccaaatgttggatgtctgctgaagagcaaaatcacccctagatgagaagcactgttttagaatgaaggactctttgtgaggccagtagaaaccccacgcattacatttagtgcttagtgaagaggagagaactttctggacacttcatttttcctggaattctcttctttggcctaagaaaaggatattttcatactcatttattaattacacctaatgtttattgaattttagtagattttatagcatttatcaagatttatagttaaataattgcatacctatgtaatgtttctcattaaccagacagtaaactctgtgaaggcagggacatagtgtcttttagtaaacatgcctggttcagtaattgttttgccaggaagagagctcagggcttttcttgcattacttcacaaccattattattatctctactttatggattaagaaactgaggcagtggggttaagaaacttgcccaaggctcagccaatccaaatctgtctaactctggagaatgcatttttctctatagtgatatatcctcaaatttattctgagcttggacatgatttgtcagaagcttcaaaactaaccaatttttatgaagatttattttgatatattattttgtttccttcattatagctgatgattggtatgtatttcagattttaaagaatgtggagtcttccagaactgttcagccacatttcctagaatttttgctttcccttggctggtcagtagatgtgggcagacaccctggttggactgggcatgtttctaccagttggtctattaattgttgtgatgatggtgaaggatctcaacaaggtaaaactcacagtgtttcaaatgtcagttgtttcttgtttgttagtcttgtttttttttttccccctttactgtgatttatagtcttgttaaaaatacaaaaccaggctgggtacagtggcgcatgcctgtcttcaagaagccaaggtgggaggatcgactgaggctaggagttcaagaccagcctggaaaacatagcgagacaccatctctacaaaaaatgaaaacatttctaggcttgagggccatgtatttgtagtcctacctgctcaggaggctgaggtgggaggatcacttgaggccagggattggagctatgatcatgccacagcattccagcctgggtgacagagcaactccctgtctctaaaaactaaacagaggtatatagaggaaaagtatccttcccctaatcccagtcctgacagggtaacttagtaacagtttatatattctagacattttcagtgtatatgaaagatatgtatacacataatgatagagttaatacaaaatgactggcttattacaatgctgataagttccttttttataatatgcataagattcaattttctatacaaatggtgtaatataggtcatccatacaaacaatacagcttcctaacaagcatgttttgtctaataagtagttttctattaaccagtgtgttttaccaactgtggctatcaaaacagtcacacttaaaggttatattcttgggatattataccaaaacctttgtagtaaacagctgaccatctctgaggattcttgcccatccccgcagatcctctgaggaactgtaatcaggataacaagtagcagagcaagtataaacttaaacttaagacctttgccccacctggctaatgctttctgttcctgggctcctgaggtcactggaaagttagtgttacctctctaaagtggataatgcctatgcccagtgcacatttttccttttgataaatatatcagttggatacttatggttgcaagtatcagaaaacgtgacccaaactgccttagattttaaagataatttattgcccatgtaactaaaaattccagaggttggttaagtttttggtgtcatttgattagcattcctgttttatttctttacaattttcctttagctttgctctccatattttggctttgtccccagcctggcttctctaatagtgcagaaaggcaattccaggctttacattcacataccacagcagcctgaagaggagagattagccagatctcagaactccctactccccgaatccggaactatatggcgattagactatcccaagcctgtccttatggcaagaaagatagaatgactctggtagagagatacaggcaagctagaactagtatcagaggtcagtcccacctgcacattttgcctgctgcagaataggggtggatagagtggctattgggatagtaaccacagcatctactacatcaaatacaaagtgcctgcccggagcccacaccaggagtcagaaaactaaagccctgtttttgtaaataaagttttattggaactcggtcacactctagattatacattgtctatgacagctttcatgctacaatgacagaatcgagtagttgtggcaaagaccctgtggcttacaaagcctaaaatgttatctgtctggtcctttacagaaaaagtttgctaacctcttgtctaaagcttcctatttgccataccttcaccagaattaggtatcttccaattttttcggtgagaaatttttaatttttaataatggttgagcatatcttatcatatttttatttattccctgagaagtacttgtccatttcccctttccaatttttggtccgattgttggtcttttatgtattgctagtaggacactgagttcattttaattgagaactatatagctctcatgaatgtttcttttgttaattcagtcttcctggcttagagcagatactattactaaaactggctgtacatttttatacagtgtcactgaccattgaggaaggtggaacataggccaacttgaggagccatagagagagaccagggatagaaatgccttaaaagcaagagtccagagataacgcacatgtgcactctctctcttctctctcttcttctctctctctgtctcttcctccctcctcctcctcttcctcctcctcttttcctcctcctcctcccttcttcttcttcttcttcttcctcttcccccctctctctctctctctgtctctctctctctctctctgcctgcctgcctgcctgcctgtctctctggcccaactcccttctgagggactgggatggtcttccttttgattatttatttactggatccaaaggactgctcccttaatctgcttcatacacttgaattaaaagccctgctaatcagaagtggtctgatatacagtcgtttcagaaattatgaaattaagattttattatttaaaaataaagacatctaataagcattatattttattctttcatactaattggttcttgttgaaaacatatattctatttatcactttattaaccagttaacatttcatgtagcaagatgatactggttttttcctactttttgaagcggtaatgtagtgtttctttttcccagaagaagtgatttcctctgaagatattggagctagcattttcaatggacagaagaaggtgctgtattatgctgatgcccttacagaaattgcttttgtggttccttctcctgtggagtccttaagtaagatgatttttgcatggtcctgttttaggatctatttttatattcctgggttgtgtgatattactgcattggaagagattttgaagtgatctaaggcattctttagcttctaaggcattataacaatatgcagaagcacaagatgtcttctcttaacttttttatggaaagtagttaaagacaagcagactgaccctctaataatctttaaatagtgaaggaatcccatttcaactgatattttgctttctttaatctaattaatcaatacataggcttattttccagttcatttctttctctaattacgagtgatccctcacctacttttctattcccatatgagagcctttgcatggaaccacctagaatcctacaactggaagtatctcatgatagcatatggccattcttctaacactgagcaagagaaacttcagcagcctagaaaagatggtggtccaagactttttaagaattgggagtaattattacttcttagtctgaactcacagttttattttgcccagaacctttgctctttgcaaattaagcctgtttgttcatgcctgaccgagtaggtggtctggcagtaggtgggaaacttcaccttcttctttgagatcatttgtaggatgggatactatacatcacgatttcagtcttatttccagactaatgacttttgttgtgccctaccttggtagctgcctaacctttgtacttggacccttgatttctcactctaggcccctccctgtcttactctctggggccggctgtgttcctggaaggttggaccttccatggtttaggtttgaattataacagctgttgggcttcccgtcaaggttctggtttactacttataattccagaagccagaacctgtccgtcctctttggggacatacctgcctggtttctctggcccagcctgttagtaccagacaagtcctcccagagctagagcctcgtccttattctatagctcctgcaattgggtctttgtctcctgttgtgaaacatctcctatgccaactgtgcccactccaactcagcttcctcctatttctgatatttggggatttttttggatggggtggaggataactttctgtgtacttatctccaaccagattgctcttaatcacagagactagatcttctgtagcttctggatgtcccagtgcctatttggcacaatgctacatgattgaatatataatctaaataattcagagagtaataatggcatttattatattctacatctgaaacgtcaaatattttctagtcttattttggttatcctttagagcaggagctggcaaaccacagtggcacaagccaaatgccgccaagaatgggttttacattcttaaagggttataaataaaatataaagaagaatatgcgagagatctgtatagccagcaaagcctaaaatacttagtacttgatcctttacagaaaaaagtttgtcagcccttgctctcgaagcaatgctttgtttaagtgatttaggttagactggtgagcataattagttttaacagccttgctccaaataagtggtatgtattatagttgctttttttcctttaccccatagctgattcattggaaagtaacatctcggaccaagatagtgattcaaatatggatcttatgccaggaattctgaaacagccatccctgacacttgagcttttccccaatcatacagacaatcttaattcctcacagagggtaagttactttgttgataggtctccaaaattttgtagtgaaatcagggtaattatagaatcctgcctgaaaagcttttaacccagagagtatttatatcagagtactgattccttagtaacttaattttttaaaataaaattctcacgattttctctttttcagcctgtaacaaatagttcattctgagacagcctttgtggtttctcttgatttcaccattctggtcccgtacttgattctctcatctgttcctttttaagcctaggttttaattttgtccctgaaatatccactaaagttactgcagtaactacatgtttttttatctttaatcttgcaatgttcatcttaaacaagtctgaccatataaaaataggaacattagggagaataactcagtatatggataaatattctgagtgaggaacacagcacctactacaagaggagctttttgctttatcttttttcttaccttatcagcaaatgttactttatctgtgatcaggtcagaagtgtaggaagattgacttagaacaaaacataacaaagacagaagtgtcagcttgactaaaggtgttcctccattgtacaggattttaggttagcttccttccacagtgaaagttatttttaatgtaagtgtatgcttaaaagagaatacggggaggtttttacctttaaaattgatttaggaaaaaaatgccaggtggtgtaatagtccctggagtagattgatttgagaatcaggagtttttaaaaggttttacagaatacagtttagagatgatcagtcagtattgcatagcaatgcaagattttagccaaatctaatacttactttaaaagttttttttatttgagatttgtggacagaactagtattcagtgattagctgcccttatactcattttctgaatgccagcatagttattccttagaacccagataaagcaccatgtttttgtttctcacttatactgtactttgcagacactaacagactaaaaacaaaaaaacaaaaacaaaaaaaaaacaaagcaaaaccatatggttatctcaatagatggagaaaacgcagttgacaaaaattcagtactcatttatgagaaaagttctcagcaaactatgaatagaactttctcaacttgatacagagcatctactaaaaacctacagctaacattatacttatacattgtacattattcttgaatgcttttcctctgaggtggagaacaaggcaaggatgcctgttctcaccacttacgttcaacatggtagaggaggggcctacacagagaaataagacaaaaggaaacatagtacataaagattagaaacaaagaagtaaaactgtatgtatttgcagatgacatgatcatgtaagtagaaaaccctcaggaatctttttaaaaatccactagaactattgaggtgagtttagcaagattgcaggaaaaacgccagggtgttgggcaaaattttaaggtaacccccagcgacgtttgcctgtgtacagtgtcctctccttgcgtgtgggtggaacttgtgactatgataggataactgtgattatgttacattatttggcaaagggatcctgtgggtttaattgggttactttgagttaatcaaaagggagattttccaagtagacctgacctaatcacaggagctctttaaatctagggctagaggtcagagatggaagaagttagagagagagtcaaagctaaatagggaccttgatactaagaaagtagtctgtgaatatggccagatgtttgtcactagtttgggagaaatctcttggtctggacattttctgtgaatgtcagagtagatataattatccggggggacttgccatggactctggtcatctggtaaagacatgtatatttctgtgctaataaagtagttttaattttaaaattcacctcaagtatgagattcttccctctgtacacatgagctttgtttagggctttagcacaaacttagctctgctgcatgcctcaaaagaggtgcagctcagggtaccagtttgctaaaggggagccacatagtcctgttaaccttgcagtgaaacttaagagttgattagggtggcaggaagccagaagcacactgcatggtaatgaagccccaaacaactcgtttttctttctactgatgagaaaaaggaattaagcataaattgcagtaggagacatttggtctggaatctaggaataacttgctgatgggacattttagagattaggatccccagacaagtagtgatgttgctgtgatggggaaggatactgctttctggccctaacagagatagactcaaatcttttaagccctcattaagatactgtgtgtaaattttgtttttattaatgcaaattataattattcagtattccttcctttttttttctttgacaattttaagccttgtcctaggttaagactgatgaacaggagccaaagaagagctttgttgcaaatgtatacactttttcctaaagtgattttccatgacctgatacttggtcactgagcaccttgacaaatgaatgactgggtagttttattaagccagttttttgttgctgttgtttttcccgctctctgtcttcttcttcttcatgtagctcagtcccagttccagaatgaggaagctgcctcagggtcgccctgttcctccccttggacctgagacaagagtttctgtagtctgggtggaacgctatgatgatataggtactgtatgaggactttgtccataaataaaatggcaatatatgacagtgacttgctaaatgtctacagggagtgggcacataagcctggtgtggccaggagctagtcctggagttcagcaagccttggtttgtaccccagctccactactcagtttctttaagccttagattactcctctgttaaatcctggtacttttttcatagttgtgaagattcgatgagaccagtagatacaaagcttttggctattcatgttggcatcacagtcagtggtttgttgccagttggtctcagtcatcccaggacctttggaaaggggaaggggaagcacttcacttaccctctctccacccacatgtcctactgtctcgttttagtataaagcttaatttgtccttaagagttgcactctgggtaagtttctcatgatttttacataagcaacattagagcattagaaatatatacttgcctaaaatcccatccagcccagagtttgtgggaaagtgtgatagttacttttcaaccaagccctcaaagatcacagaacatattttctaaaaactctttgctttagatgaaattagctaaaaaatgtcttgagagagaattttttaatttgtagagaataattaagatgatatttcaggacagcacagtccatatatttgccactcacttatgtaaagcgattagaaaattagatttcctattatctgtttgggaaaatgagggagatattaattgtaatgctattattttcttccagaaaactttcccctctcagagctgatgacagagatcagtactggtgtggaaactactgcaaatagtagcacttcactgaggtacactctatttgcttgaagttcatcagcgtgtctttttttaacatattgattgcagcttaataaataaggaattatgaaacgaaagagttgtagacaactagaaataaaaacaaaaaagatcaaagaaagaagtttgtatacaatgtacaaggttatcaaattattatagcatggatttttttaaaaccactttattgaagtataactgattgacttgttaaaagctatacgtatttaatgtatacaacttgatgagcttggagataagtatatatgcatgaaaccatcacagcaatctattcctgaacacttctaccatctccagaagttttctcctgcccacttaattcattattattattattttgtaataagaaccacttaacataagatctaccctcttagcaaatttttaagtatacaatactgtattattagctgtagccactgtactatactgttgatctttaggacttatcctgcataactgaaactttataccaccttttggctaatacctccacatttttccctccctgcagttcctgacaactagaattccactctctgcttctctgagtttattttagatttgtcatataagtaatatcatgtggaatttgtctttttgtgcctgccttagcgtaatgtactctagattcacccatgttgttgcagatggcaggatttccattttaagactgaataatatttcattgtatgtgtacaccacattttccttgtctattcgtccattgatggatatttaggttgcctccatatcttagctattgtgaagaatgctgcagtgaaaatgggagtgctgctatctctttgagatcctggtttcagttcctctggatatacaccctgaagtgggattgctggatcatatgaacattctatttttaatttgttgaggaaccatactgttttccacagtggctgtaccagtttacatttccaccaacagcatacaaggggattcccttttctccacattctcgccaacacttgttttcttttggtttttttgaaaataaccatcctacctggaatgaggtgctatctcattatgattttgatttgcatttccctgatgactggtgatgttgggtgctttagcaggagttttaatagtataattaattgctattttacatttatctagagcaaaaagaaaaatggagaagtagaggcaattaaatattaataaagaccgtaatagtagggcagcaatattagattgaaataatggagttaaattggccaaaacagtgtggccaaatagcagttaaaatatcctaaatcatatgagctaattaacggaaatatgtttctaagcaaaatgtaatactttataattgggttaaaatttgttttacctgcccatacacaagaaggataaaaagagaataatctgattctaagaatggtaacaatgtatttgtataggctttgtagttttcaaggtttgcttacttgtttttggtttataactctaagagttcaacagttattttctgttttactagtgggataaaataggctcaaagaggttattccttagtatcacacatccagtaaatgcaggagaaagctacctgaatctaggcctttgaccccaaatgcattgaccctgcatctctctcatcacagagctaccctgaaacttgatattttaagttccttttagttatgtgagctgattcaaattgcatataagatgaatttattctaatattgttaggtgattgttgttgaagtcagtaaagatgatttattttagcattatcattttaaacttctaaaagagggcaagtcattcttaaaacttccaggttttatatgctttggtgttttaaaacaaatcacagatatcttaacgttccaaatacatcagtatgcatctgaaaagtaagaaacttttcagatagctaaacaacatcgcaataataaagttagtaatactttcttaatattatctaatagccaacattcaaatttcttcatttttactaaaatattcttcacaattggtaaagaattcactccaggactatatatctggttttaattccttcagtctcttttaatctggaacagtccttttttctttatgacactaacttgctaaagaagagactatagaatagtcatgagtagacttttctggaactaattagaagagacttacttatcatttactgtctttgttgttttcatctttttttttttttaatttaaaaaaacaaaacaaaactgggcacaaggtatcaccatgttacccaggctggtctcgaactcctgggctcaagtgatcctcctgcctcggcctctcaagttttcatctttttaggtcaaaggttgtaatacaatttgacagtaaaatgtatattttattggtagattagcaaagtttataatttgtcttggggacagaattactcaaggattgatttttctttttttttttaatgtcttgaaagattgattcagtgttgctttggccaaaatcaccttacctatatagaaagaaaattcattgggttgcaaaaagaccccaacatgtagcatcacaaataacatgtaatattagatgggttggcctatccctggtgtgtaatgagtaactcgcccctccataggagcagttgccaactttagcatctgctgccttgccagaggctgtgagggctttggccctgccacagtgcggccatttatcaccatagccgagaaggacatttgcagctggcttagattaatggctctcccaacgtccttccccaccctgaaaaaaaattatatcggggattcctgtcatgggccgaagctgtgttcctgcttctcctctgggattatcagccttgactatgctgaaattccttgtactctggccggccacacttttgttccctataagaagaggaactaaagtgaaagtcccatagctggttgctaaattcttaactccatgcagcagagtactcttggcctctccttccacccagtgtccctattggttttccaagcatatatattttttcagctcctttctgttagcttagaaagcttgacccagtaatggacctttaggaccagatgttatagggggtagcagcatagattcccagaaagcagattctgagcacactgaccccttggcttttctcagaccactgccaagcaacaggtccctttactaatcttaggctatatgtgggggacttcaactcttgggtgtctcggggacttcaactcttgggtgtctgagataacaattttcttttcttaagatctacaactcttgaaaaagaagttcctgtcatcttcatccaccctttaaacactggattattccggataaaaattcaaggagccactggaaaatttaatatggtcatccctcttgtggatgggatgattgtcagcaggcgagctcttggtaaggtcttcatatgtggccgaagagttaaattttctttttctttatcatttttataaaccaaaaagaagtaaaaataaggaaatggtgataattaatagcttccacatgtaggaaatggtatggctcttgttaaaaagggagcatgtttcgttctttttaaatctgtccttaatctagtaagtgtaagtaaaacctcactaacttctagtattaaaatattgaagatagctgtttgtaatccaggacagaaaataggtttttagaatagattttgattctccttttccttgtcattgtgtgtttcttctgacagttttatcttagcactatgtctatctctctggggatgggaagtttgcaaattgaatgaaatagttttgagtatgcggagaatagttcacctgaatacttacagttcacctacgtaagtgactagtttctaacgtttattttaaaactctctattttcaaggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtagtttgtgaaggattctaatatggggttcaggaatagcctctcaacgctactaattcagatctctcccagagaactactggatttcctcataattgacaaacatgagtgaccacctctttgggtggctactgttagaaatggctgttgtcatgttttctggactttgccagccaacagatccctgccaggttttggaaatacttctattacctcgctgctacttttctgcagggataaaacttttgaggtggccagacccagaacatccaaggattcctgttacagtgctacagtatacactgctcatttatcctattctcatgtgctttcttctttagtaagattattttaagaaaataagtgatatttaaagtccaaagaggaatgatcacagttgtataaggggtgttttcccacttgaactctgatgtcagtcgactgtgggtcagagctacaaccatctgtttggtttgatgttttggtggtttacttacggagtggggatagtgtgagacctaattccctgtgcaaatgtctcttattccagaaatgtgcattttgtcatctataagcaagaaatatgggcatagcagctcttggtttaaagtttgccataacctgttcatgtttgttttaagctcaggtaaagataacctcctctttctatgactccagtttccattcaggttatagtattattcaatagttgattttctttttaagctgggcaataaattgatgtttccagatggtaacatgggagagggcatataggataaagatgagcaaattctaccctaaaaatgttctagtagttcacaggaagaagatgaggtttaataactttcaaggtaattctagattgacattttgaggggaaaatgggctcttgttctagttgaagtgagcagagaaggctataaattaatatgtaacttacagcattccagaggttaaaaataactgatgcagatgtacttcttcagtgtgattcttcagatcaaacttttacttttggcatagttaatttcagaaaaatgtgctgtatgtgtgtgtgtatgagggttggtcttgctgatccttcagttagctctaaattctggcaactccttgtaattccaatgtatttgatacatgaacaatcatgttgaatgcatttgtgatctgggagacttcctcgtcttccagggaaggaaggatgtgcagcccctgaaggcatgaaactcccagtgtgtacggagccagtggaatatgggatacccataccttaccaggcgctggttccttctgctcacaataacatctgcccaaagagggagtgggaagaacgcttagctctttcactagtatggatttgagttcatggtcactatttttacccacctgcctttgttaaaaatcactttgagtagaatagcactggaggaacatatttagcacctaatattaatatttagtagtccattgataaatttgccagcatatgttctagcctctggggggaaaccaggaccacttttgtctgtggcttaaacagttcagttgctatatctgttgggtatgccgggggtggatgagtgtggcattccgtgaagaggaaggtggtaagtaaggtttcccttctactgccttcttaagttgcaggagggagcttttctcctcccctctggttgggagcactgaggacagtgaggagggcttttaccttgttaatcctttccttatttagctagctttcctttttgtctagggcttcctcttgagaccctcttccatccattgggcctttgaaaggactaatcagacacacacacacacacacacacacacacacacactcgcatactcatgcacattttccttcatttccagatcctttatttcagagcagcccattttcctctggattcattgatgaatacaagtacccacacctttggccagtaatgtcagttacctgctgcaggttctgtgtatgaggccttcatgaacggttaccttctccatacactagggaagcatttgtcagactctgcagactgggttctagagaggcagagtctttaagagtattcatttcttctggaaggtggagctttacccaaagtggaagttagccttgctcaaagatgtgttttgtggtaggtggtaaaaataaataaataaataaataataaaaaaagaaacatgtattggaggtaatttgacactgctgctggcagtagttctctattcaccattttaaagcccattcaggttctctcttcctgaaaagaactgattgctgtgtttacatgaaatgacattggagtcagatggtctgttttaaagatttccatgacagcctcttttcctgagttggagagattggaggtggtctatccgtacgatgtggaatcaaacggtgggtttcttagtagctaaagaagccatgtacttctagtgtgtttctcagaatatcaactcatgttcttcagatgcttttctttttttaatggtgagggaaaaggtataatttgggattccacagtgccttgcatatagtaggcgcccagtaaatacttgttgaagcaaaccaagtttcccaagtcctcatctcttatagtgaccaagacatctttctcctctgaagggcttggcagttgtggctaaaaaataagcagtatcattatttgcttgaaatcatatatacagtttgtatgaatttcagtatgttgccaagacatgattttttcttattgtattttctgtaaatatttctggcactgaactgtaaagtaaaggcaaagtgtaaatatgaaggcgtgcccgtgccccttgcctcctgtgtttcatcttcgtcggttagggaagaaggtccagaggtttgtttgtatttatgccgatcctttgtccagaagaagcccatggaatattgaatgtaatacatttagtcaattaaattttaaggagattcttatctaataactttgtgtgtgcttttggatacaggctgaggctttactcctacactggtgctgttaattttaccctttcaggggatgtctgctcggctttggctgccctttataatttagatctgtagtttaaatgaacattaaatgagtatttcatgaaatactcaaagtttgattaattttaagaaaagtatttggccttctctgctggaaggagcttgtataattaaaacactgccaatagaggctcacctttcaggggctgcgaattgctgaggagatagatgcttatgttacgggagcaagaaagtgccagctgtgccctctgcttgcagaaaatttgagccctagtaggactagacagtcaggaaaggggggaggtgcagagatcatcccctgccgcccactgccccctttgtgaagggcatcttggagccagatgagtgccttcaggcctggatcacacatagtggagtgaatggaccacttgaaacaatcatgagaaccattgtggccatgcctctgccaagagctgctgacgtgtgccctctgaactgtgcctgggagctgcctaccttgcactgtgtgttctgcctgctctgcccacgcacaacaggacctccagctgggcctagtggccagagacgctgactgcacagtagccctgttttggtgtctggaaaggttttgtagccagaaaaaaaatgtgtgctcaagcctttcccagctatgctgctcagctctctctctgaccgcagccccttcaggacccagttccagggaatcacccccaacccagaccacctgctcctccttctcttggcctctgggccctgcatcaggagcaccctgccagagcactgctcctcttggacactcattctagtccattttcccagacttcctcttgtaggaattctggccttcccacagctgggctaggactcttgaaaccatgccccagctctcccagcccctcccatgctcttattttttcctgttgctggccccatgcgcccttctccttgaatcggtgtcttttcctataagggggttttctactccatgtttttccctaagtttaccacccccttcctgcagctgctcccccgcctggacctggtttgccttttcaacaggtgcttttaagtcatgagatgctgtagtctcaaaatcaagcctgcatcagaatcattctagttgcttatcagtgtgttgaatcccaagccacacccccacccccaagaggtctgaggagacgaaggtgagcctgggaattggcatgtttaataaatacactccagcacccacccacctgctggcagtcacaggcaggtggtccaagggtcctcttggagaataccatgcagcagccactccagtgggaagcccgaagcctcctttctgccatggtctggcacatggaggtttactgaatacttgatgagtgaacggatgacagataggagaagatgaggatgacatgtggaagtgttctggccactcaggagataaaggaacaagattcaagtcgttagaagcccctcactgaaaaccctaataaggagaggcacaagctttcagattaagtaataatcatttatagtcatttaatctagtaataattagaataatctactatgtgttagattttaaaagttttcagtggcagcccagtgaccaatccagcctggcagacgttttgtttagccaacagtgctttgacaaggtctgatccgacattttaaacttgggagatttcacagaaatccagactttttgcctgtcttgggaaagttaggagtcctgcaataatggacctgcatttcacttgtagcagttattggttggagctgccatcactgcatgcttaggatgcagtaagctgcatccagtttgccgcagtccccagcacccccaccaagtgtggacgtgggcacccacagctggtattacaggacctggggacccagctggctcctggagggggtctgtgacttcagatatatgaacaccgatcctgggggtaatttttgtcccatctatttttctaacttaacagaattatctccatcttacaagaaaaagggtcagaggggtgtcatgaacccaatagctactggactgagattcaagcccaggcctgcctggaaacctgggctttttaattctcagccagactgtctgtctcactgcctcacttcccaccctttcatccagaacagctctccctcaaagtgtcccctgcatgctttgcctgaagtacactgtgacttctttgttatgtcacagcttagtcacagttgggctgagagcagagcatggcccagcctgccaggtcccatggggcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaaggtgagcttcttaccccgtccaggcaggaccctaatcctggagctaggcagggggccaaataggccagtgtgtcctgaaacaactgcagaaggggcttccttcagtcattttaagtgctcgcttagatacaagcagtcaactcttaagtggaaaggattggtttggttgtttagggtttcttaacctagagttcgagagtgagtcctagagtttgaacctagagttcgagagtgagtcctagagtttgaacctagagtttgagagtgagtcctagagtttgaacctagagttcgagagtgatcttttgaacaaatcagaggttatcgctccaggcagatgaacttccaggtgcccctttcagctggggtgcaaggctctgtgagcagagcgtgggctggatttcagccccgctcaccctctcaattggctgcttttgtgcagtaaacagcttgcacgatgggatacagcagccttaggcatttttcagatacctgcagaccactcactgtttctgcctaagccatgtatcagaaaggatctggctgctttgggagacaggctcatggaagccagctgacattcaccctgacctcagcatgccaccaagaggagcaagaggtgggacgaagctggctgtggaggaagctgggggtggctggatcaggatatggcctggctgtgtggcaggagtgggacttctgctcctctggcatgtgtctccctgagcatccccttcagcaagaggtctcttcctgctggacacagtggctcacacctgtaatcccagcactttgggaagccaaggtggccaggttgcttgagcccaggagtttgagaccaggctgggcaacgtccctacaaggaatacaaaaattagccaggtgtggtggcatgcatctgtggtcccagctactgaggaggctgaggtgggagaattgcttgagcctgggaggtcgaggctgcagtgagccgagatcacaccactgtattccagcagacagagtgagaccctgtgtcaaaaaaaggcctcttcgtggggaccacttgacctcctacctcctgctgctgagtgccatgacctttggcaagctaggcagggagggcgcagcacatgccgccagcaatggtcagatgttgttgaggcagggtgagaagtccctccccacacccctgctagccccatgatctcaaatgtaggggcttataattatgtaattattgggagttcctggcaagaacttgggatgtccttttgtttctagaaagtgtttatttaaagtatattctcctcatagtcctagggtagaccacagccctccctgaggggcacggtttaggcattgggccccacagctggtagggagtcagccttgtttgcatactggcgataaaagttgtctctctggagtctggaagatatgagttcagatatcatccttttttttttatttttattttttgaaacagagtcttactcttgtcagccaggctggagtgcagtggcacaatctcggctcactgcaacctctgcctcctggcttcaagcgattctcctgcctcagcctcccaagtagcggggattacaggtgcccgccatcacacctgtctaatttttgtatttttagtagagatggggtttcaccatgttagccaggctggtctcgaactcctgagctcaggtgatccacccgcctcagcctctcaaagtgatgggattacaggcatgagccaccgcacccagcctcatccttgcttcttaatagttcctaataatagtgaacctgtttggaacactgactatataccagaccttgtgctaaacactggacttgcataatcttatgtaatcctcataataaccctgcttaataatacttaataatatcacaattggggaaactgaggctaggagaggagaagcaacctgtccaaggtcatacatctgtgaactacttaagagagccaattgtctgccttcaaatcctgactctgccacctaccagctgcatgactgtggacacctctctgagccttgcttttctcatctacaaaatggagacaacactagtacctgccccttggggttgtgacaggcttcagtggtcgatgcatatcgggtacttacagggcagggcacacagtacgcatacacacctggcacatcgtaggttcctgtaggctgagaaaatagtccagccaatgctggttttgtcaatgtgggaggaaatgcaggtggtgtggctttggatgccttctccagagaggagacatttctcctaccacccaggccaaggcctgcagcatgagtctcctccagcattcactctgcttggaggcccaactccaaaaccatccacaacctaccccactccaacccctccgcagactttctcctgagaggctgtttactggtgtcatgtggcgttttgaaataagtcatttgttaattttgcaacgaagagaaaccgtccttaaagtgaggtgggcattcctccctcaggttctccgtcttctaaaactcccagtattattgtgcgtgttttgcccttgtgctgggaactgacccaatgtcagggtttggggggctaaggggtcaggacacccagacctgcagttttctattctgctgcagatccctttattggaatcagtttgcctgaaatccagtttgaaaagcagacaggagtagctctgccgcctcctccccaccaccccccaacactcctgctggctcctcagggcagtttcaggcctcagaatacagagggttaagcgtggaatacccgacaggatgcactttcccaagtcgaaggaggagcaaatggggaggaaaggagagctgcctgatgaaactggcactgaggcaaaaatgataatgggcagctcaactcctgcagaagctggtcagtggggacagtgctactgtctggccatgacatggccataaggtggaggaagccacacacacccttcaaggggaagatgccctgctgccggcattttccttttgcgatttgaaaggagtttgcagaaggatgaagggaaacctccaaagagatgggtttggggctgaaacagaagagtggcgcaacaacccctcatggtgggtcttggagcaagatgttcaattcaaagctgcctttaaatcctctgagtccaaacacacccaatggaaccgtggagtggggaggctgaatttgcatccagtagcaccactccctggctgtgagcctggacaagtgatttcaccatcctcatctgtaaagtacaaaaaatactagtaattgacttcaggaaggtgttaagaggatcagatgagaaaatgaatgtaacaacactttgcacatactctatgttcaaaaaatactctctctagtgaagaacagtcacttcacgctatcctactgactttttttttttttgagacggagtctcgctctgtcaccaggttggagtgcagtggcgcgatctcggctcactgcaacctccgactccctggttcaagcgattctcctgcctcaacctcctgagcagctgggactacaggtgcgcaccaccacgcccagctaatttttgtacttttagtagagacggggtttcgccatgttggccaggatggtctcgatctcttgatctcatggtcacccgccttggcctcccaaagtgctgggattacaggcgtgagccactgtgcccggcccctactgacttttaagacatactaactgccaacactgttgaaggcctgtgctaagtcctgtgctgagttttacatgtctgccttcggttaaccctcatcctagaagatgctgatattatgcccattgtacaaaaacctttgttacttctctgcaactagtgaaacaatgcaagagtttagtaagaaaaataatcttccccatccctctttttttctcaccctacctccccaagatgagtctgttagcaaactcattaacgtgtgcaggttttcaaaacaaattggggaatggtgcagcatttgcttttcaaaacaaaaagatcctacatttctttttaatttgcttataatataccgtagatattctgcaagtcagaagatacagatatgatgcaaacattttaacagcttcatgacaagccatcagacggagggtccgggtctccatgtggtgtgactctcccacagcttagtcacccagatctctcgtgatctgtggacgtggacacagtttccaggtgttttattgttcgtgtgtgcgtgtttcatcacaaaacagggctacagtggagatcattgtgcctttgtactcagatgtttgttaatgaatgaactagtggactagtggcctggatgggtcaataactgtgtctcttcactgcctcttcctggaccatgtccagtacagtatgtcatttgctcacctctgtgtcctcccctctagatacggccattttccaagtcacaggagcagccttctttcttggtccctggtcaccctttaaggccctgaagtcttcctgaggcctcaaggctggctcataggattctgccttggccctagcctcaggcaaggctgcagggatacccaggcctggcaggggactccttcctgggtcaggggtaggagacaggatgtgaccatccaagaggccttgcctcgtatctccacagattcagaggaaaatgactccagtgtgtgcttggattgggagccctggagcaaaggcccagctgagttttgctggaaggggacactccacggccaagagaaggagaggccctgctggtgagcctgctgtgccaggtgaggcccttccaggggccagggggagcctcaaggcccacccaaagccttgggcagctgctatgtgggcaagaggctgcctccaccatattagaggtatgctccctggccatgctggatgacgggttctctccagcatgtgagagccttctgcttcattgtgggggagacctggtgttgccctgttaaagggccagccccctgtgccacaaggagcctttacaaaggtcccctaccctttaccctagggcctcaccccccaccactttcctgatggtctttggccagctgttccctcagacgtctgcgtggggcactccctcccctctgagggcttgctctaatgtcactttttcagcagagtcccactggccaccctattcgatattgaagcccccaccctatcctccgcatcgtgctgcttaccctgctctgctttcctttcactgtagtacttaccgccttctaacacgtttgatcgtggctgcatccaaagccccaaaatactgccagacacatgctagaggctcaatacatgtttgtggaaggatgacatgatattattattattattattacaatggctggtatccttgggggctcaataggtaccaaggcctgtctgaaccgttccccttccacaagcttacttatgaaatcctatgatgaggatatgattctcacctccatttacaaatgaggcacacacacatactctcatgtgaggtgtcagggcaatcagatgctgtacccaaaggcccttgcacccattgaattcctaggagacctcagccattccagtggggttagatgccatctctataccaatggccccaaaatgtgtgtgtctcatctaatctcctcccaagctttattatctgtctgcttgacaccctctcatgcctagaataggaatcttgattcccattgtcacccagccaagcaaaacagcaccctgatcttctgctagcttttcttcatctccatgaatagcaccactgtggattgattctgttgcccgagtcacgaacccgggagccagcctctcgcctctctctcccaactctaatctccatctctcacgtgtccgcctttctctgccctactctgaagttggttcatgcagtgtgttcactagcccccgaccctgtctgagtggagggaggaggtggtgaaaaggagggcccctcacttaacctaagttgtaatgattttttagccttttgggtcccaccttgaccactgagggcccttttcccaggaaaactcctcctatgaatgccctcagagatttgtgtacggggccagctccacaggtgtgtaacctgcagtcccacaaggtcccaggcttggtttcatgcttggctattgctgtcttgaaattcttaatttttgaacaaggggccccacgtgttaatttgctattgggccctgcgaattatgtagcttgatctgtttttatataatttgtggcatgagaaaagattttcggacgctgcacaagaaccctatcccatttatgcatagcccttcccttcccacccccatcacttacccacctctttctttcttttttccctttttttttttttttgagacggagtctttctctgttccccaggctggagtgcagtagcgcaatctcagtttactgcaacttcttcctccccagttcaagcaattctcctgtcttatcctcccgagtagctgggattacaggcacatgccatcacgcccggctaatttttctatttgtagtagagacaaggtttcaccatattggtcaggctggtcttgaactcctgaccttagatgatccacctgcctcggcttcccaaagtgctgggattacaggcatgaaccaccacgtctggccttacccacctcttttttctcatcccaatggcatccctagtcccaaccttccttttgtttctagtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaacctaccaggcctgaccaagtcattcattcaaccagcgtaggtccgagactcagccctggccctgattcaagccatctaggaccttcttgggaatgcccaaccctcttccatctgttcaatggggatggggggcttgctctgaacttccattctctgatttcaaattcgctccttgattggacttcaggctgatcttaataacaaatatttgataaatagctgcagagtgtctaccaagtgcctagtttggtaggagcaggaatagctataggagtagctcaacatttagtgaatgcttactacacgtcaggcacttttctatgtgctttatacatacgattgctggccgagcacggtggctcacacctgtaatcccagtactttgggaggccaaagcgggtggatcacttgaggtcaggaattcgaaaccaccctggccaacatgacaaaaaccccatctctactaaaaatacaaaaattagccaggtgtgatggctcacgtagtcccagctactcgggagactgaggcacaagaatcgcttgaaccagggaggtgaaggttgcagtgagctgagatcgtgccactgcactccagcctgggcaacagaatgagactcggtctcaaagaaacaaaaacaaaaacaaatacatacgattgcttttagcccttgtaagaattctgcaaggtaggttggttacctctgttttacacatggggaaacaggcacagagcagttagtaagttgctcagagtcacactgggagagttggcatttgaacccaggttccatgactccagaaccaggtcccactccactgtgccagttcttccccaggtggggtgctgggggaggtatggtgggaggcgtaagtttccagaggctgcaggatgatgggggtggggggataaagggacaggccctccaaggtaccaactgggcatcatctttatcccttctttctctctcactccacaccccaccagccaccacgacttctaaatgtccaaggagagagaattgagcctgaaatcttagcttgtctcctggcctttggtctcctggccttggtctctgctctttctgccctgttggagtgatccacccaaagcacaaattgggacatgtcccttcctggcttcacgtcttccatgctttccgttgtccgtgggctaaagtctgagctcctcatcaggtgcagaaagccaccttttgggatttgagccccactgaatttgctggatgaggtttctattcttacccacaggctacaatgaacactcttgaacctaaatccttgcccacaagtgtgcttctatccagagaacacattctgaaaggagaaattgttgaatataagacatgcatttacattttgcagaaactaagttgctcgaccaaaaagtggccccaagggtacattagaagtacctgtttccccagtcctttgccccgctgtgcaatcccaacatgctctcttacatacagacacacacacgcattatcacacactcacacacaccctcatacacacactctcatagacacacacagacacacaccctcatacagacacacatacacacacacaccctcatacagacacacatatgcacacagacacacaccctcatacagacacacatacacacactgtcacacagacacaccctcatagacacacactgtcacacagacacacatacacagacacacaccctcatacagacacacacatacacacacacagacacaaaccctcacacacactcatacactcacatacatatacactcacacacaccctcacacatacacactcatacactcacacatacatatacactcacaccctcacacatacactcactacacccacatccacatgcatacacacacatatgctctcagacaccctcacacatacacgctatcacacacagacacacacactctcatacactcacacacatgctcacacatatccactgacacaaacaccctcacacgtacaggcacactatcacacacagacacacacacacactcatacactcacatatacacactgtcacacagtcacactcatacccacacacacatatacactcactcatacagacacacatacacacaccaccttatacacacagacacactatcacacactctcacagacacacatgcacacacgtattctcacacatttaaatattttgttttccatcaggctgtggctttgaaatgagaatgagaaggaaacctgggctagacacacatccatagacacgcgcactcacacacacgcacacacacccacaaccctcccttctccacacaagccttgctccagctgatgagcttttgtcaccacggggttttcctgggagctgcaggggtggcgttgaatgaaccctgttggcaactcctccctgtggtggaagctctgcctggcattgtctgcatttttgccagatgccccgttctgtggagtctctgtgcattgcttactcggccctgccccactgtgctgtgaggggctgctgggccattgttcagcctcccttctggcctagaaaagccagcagagccccccagccctcttgccccacctgctgaggaggcaaccccgaggagagtgagtgcagtgggccctgcactggggtctggggagagcatctgccatgcccctggaacctttgaggcagaaggcagatgaggccgctcctcagggccccgggcaggtgacagctctggagaacaattgtggggagtgtggggagacgccttccctgctttggtgagggctgagaccccgggcctctacggatgtggacgaggtccccattctggcacacacagacacacacacgcacacatgcacactcatacagaggagatgggcatgtgactggtaaacacatcccatgacactctagtcacaggctcccgagagacatcatccccacgtagcagccacggctgagtgcccatgcattatcccactggatcctcacaacagccctctcagtcgcgtcatggttccattttcagacgaggaaactgagattcagagaggttaagcaactcgcccaaagtcacacagccatgaagtggctcatttttctgactcttaactgggatgtgtgtctccagatccacggggatgcccctggctcttcctagagctgaatgatggagcttaaggctgtgcggttgatgtttgtaggaaactcaggtgcactcgggaccgcaaacctgtctccccaggctgaggggcgcagggaccctgcgaggacagtcaccagcatgacatgggagcaccgcaggggcatcagcaaagcagggtgtatctgactgtcggtgcatctcattgaaagccacaccccttgtcacagcatatcttctaggcacaggcttattttctacccctaaccctggggccacaggcctggactcccgagtgcaagcccatcaccatcccattcagcctcagtgtcatcgtctgcaaaacggccaatcccctctgcatttgcttccaggagctcccatgacagagtgtcacaagctgggtggtttagaacaacagaagcgtgtgggctcttacttctgggggctagaagtccacagttatggtactggcattgccaggctccctccaaaccctgcagaggaaggagccttccttgcctttcacaggttctggtggctccaatgtgcctcagcttgtggcagcatcacccagctgcggcctctgccctcacatagtgtccccactgtgtgtcttcccatcatcttcttgatatgcacacctgtgtcggggaccgattttcccctttcagagggacaccagtcttattgggttagggcccaccctaccaaccacattttaacttgattatctctgtcaaaaccctatttccaaataaagtcactttcatgcgcgtccatgtgaagagaccaccaaacagcctttgtgtgagcaacagggctgtttatttcacctgggtgcaggtgggctgagtccgaaaggagagtcagcaaagggagatgggggtggggccgttttataagatttgggtaggtaaaggaaaattacagtcaaaggggggttgttctctggcgggcaggagtgggggtcacaaggtgctcagtaggggaatttttgagccaggatgagtcagaaggaatttcacaagataatgtcatcagttaaggcaggaacaggccattttcacttcttttgtggtggaatgtcatcagttaaggcaggaacaggccatctggatgtgtacatgcaggtcacaggggatatgatggcttagcttgggctcagaggcctgacattcctgtcttcttatattaataagaaaaataaaaggaaatagtggtatagtgttgggacggtgaaaatttttggggggtggtatggagagataataatgggtgatgtttctcagggctgcttcgagcgggattaggggcggcgtgggaacctagagtgagagagattaagctgaagaaagattttgtggtaaggggtgatattgtggggttgttagaagaaacatttgtcatttagaattattgatgatggcctgaattgtcatttagaattattgcatgaattgaaaaactaaacggaataagagaaggaaaaaaacaggtattaaaggactaagaattgggaggacctaggacatctaattagagagtgcctaaggaggttcagtatagccttgccagcaaagattatttatttactttaagagttaagagtggcggtttggggatagcaccaggagatatcagctgtgatggcttgaagaaacagtgtaaactggcagtgtaaacaagagcagggcatgtatgagtagttgagaacagtgaataggagtatgactagatagtagggatgacaagttttttggggcacagtccaagttggtctggtgtctggaatgagactggggcctaataaaaaggagcgtccatgcagaagctcaaatgggctgtaccctgtagcattccgaggacaggcctgaattctgagaagggaaagtggtaaaagtattgtccagtcctttttaagttggtggctgagcttggtgaggtgtgtttttaagactattagtccgttctacttttcctgaagactgaggaccttaagggatataaaggtttcactgaatactaagagcctgaaaaaatgcttggctgatttgactaataaaggccggtctgctatcggactgtatacaggtgggaaggccaaacagaggaattatgtctgacagaagggaagaaatgaccgcagtgaccttctcagaccctgtgggaaaggcctctacctatccagtgaaagtgtctacctagactaagaggtattttagttttctgacttggggcaaatccctgagcttgatgtgtagggaagggagggggcctgaataatccctgaggagtagtagaatagcagatggaacactgagaagttatttccttgaggatagatttccacgatggaaaggaaatgagaggttctaagaggcgggctagtggcttgtactatagcatagcctgccttcgctggtgtgtggcgattaggcctggtggaactgccatcaataaaccaagtatgatcagggtgagaaacagggaagaaggaaatgtggggaaatggggtgaacgtcaggtggatcagagagatgcagtcatgagggtcaggtgtggtatcagtaataatgtgggaggccagattgaagtccgggccaggaacaatggtaattgtgggagactcaacaaagagtgagtacagctgaaggagccgcggagcagacagtatatgcgtcaggtgtgaggaagaaaacagattttggaaattatgagagctgtagagagtgagttgagcatagtttgtattttaagggcctctaaaagtattagggcggcagcagccgctgcacggagacgtgatggccagcctaaaacagtaaggtcaagttgtttggacaaaagggctacagggcgcgatcccggtcgttgtgtaagaattctgactgcacagccttgcacttcggctgtgtgtaatgaaaagggctgggataagtcagggagagctagggtgggggcagtctctaaagctgtcttcaaggaatggaaagaggtgtggggaaaggatttaggatttatggagtcagctaggtttccttttgtgagtttatataatggtttttttaggatggcaaaaccaggtatccaaaggcgaaagtatctaaccatgcccaggaaggaaaggagttgttgttttgtagaaggggttggggtttgagagatcagtcagacacgatcggcagggagagcacatgtgtttttatgaagaattatgctgaggtaggtaacggatggagaagaaatttgagctttgaagggggatacttggtatcctttggagaataaatgctgaaggagcagaagtgtgtcttgttgagaagattcaaaagaggggcaacaaagaagaagctcatcaatatattgaataaggtgagaagcggaggggtggaaagaaagtaaatcatgagaaagcttggctgaagtaatgagggctatccctgaaaccttgcggcagcacagcccaggtaagctgctgggactgatgggtgtcagggtcagtccaggtgaaagcaaagagaggctgggatgaggggtgtaggggaatagtgaaaaaagcatctttaagatcaagaacagaatagtgagttgtggaggaaggtattgagaacaaaagagtgtacaggttgggcaccacagggcggataggcaaaacaatttggttgataaggctcagatcctgaactaatctgtaaggcttgtgtggtttttggacaggtaaaatgggggaattgtaaggagagtttataggttttagaagcccatgctgtagcaggcgagtgataacaggctttaatccttttaaagcgtgctgtgggatgggatattggcgttgagcggggtaaggatgattaggttttaatgggagagtaatgggcatgtgattggttgccagggaaggagtagagatgtcctatacttgtgggctaaggtgggggcatacgagaggaagacacaaaggaggctttgggttggggagaagggcagcaatgagatgtggctgtagtccaggaatagtcagggaagcagataatttggttaaaatatctcggcctaataagggaactgggcaggtggggataactaaaaaagaatgcataaaagagtgttgtctaagttggcaccagagtgggagagttttcaggggttttgaagcttggccgtcaatagttacagcagttatcagggcaagggaaacaggcccttgaaaagaaggtaacgtggagtgggtagcccccgtatcgattaaacaggggatggacttaccctccactgtgagagttacctgaagctcggcgtccatgatggtccggggggcttccgaggcgatcgggcagcgtcaatcttcagtcgctaagccgagcagatctgagaaggagtcagtcagacagccttgggctagagctttaggggctctaggagtggctgccgggcgagctgggcagtctgccttccagtgggtccttccacagatgggacatggcttgggagaaatcctgggctgcgggcattccttggcccagtggccggatttctggcacttgaagcaagatcctgatggaggaagtcttgtaggaatgcttgactgctgcggcttaggtgtgtgcggcttaggcattttgaagttcttgtgtgctggaggtgtggctgggttttgtctcacagcagaggcaagtaattgtaactcagacatgcgttgccgtctggctgcttcctctctattactgtacaccttgaaggcgaggttgatgaattcctgttgtggggtttgagggccagattctaatttttgaagttttttcctaatgtcaggagtggattgggtgataaaatgcatattaagaataaggcggccttctggcccctctgggtctagggcggtaaagcgtgtaagggtcgctgccaagcgggccatgacctgggctgggttttcgtctttacctcgggtagtttctctaagtttgtcagaattaccagctttgtaagctgcctttttaagcccttcaactaggcaggaaatcatgtaatctcgcctagctgtacctggggaatctgcctgatagttccattgggggtcctctcggggaactgctctactgccttcctggaggtcaagttcatgaagccggcggttatcagcgtgagattgggctagagaaaaaactctttcccgttcatctggggagagggtagaagtcaggatgacatttcagtcactccaggttaaactgtaggacagagttagatattggaattcctgtatatgtttagtggggtctgatgagaaagagcctaaatgctggctgatctgagagaggtctgacagagaaaaaggtacatgtaccctgactatgccttcagctccagccatctctctaagaggaaattgtgggtaggtggggaagagcggaactaaactgtaagccggaccgggtatgaggaagggaggtggtagaaggattatagggtggaggagtggaggctgaggaagaattgggacttagctcggcctggcgacgagcagcctggggaggaggggaagagtcagatgaatctgtagaaaaggaagactggaaagactcagcgacacttggggttgggactgaggggacaggcgggagggaaagaaggaggatttgggaggaatcgcattgggaacagagactagggagggaacgaagtgtgaaaaatgtctggatgtaaggcacctgggaccatttgcctatttttcaacaaaaattatttaggtcttgtaggatggagaaattgaaagtgccattttctggccatttagagctattgtcaagtttgtatcggggccaagcagtgttgcagaagaagataaggcatttaggttttaggtcaggtgtgagttgaagaggttttaggtttttaagaacacaggctaagggagaagaaggaggaatggagggtggaagtttgcctatagtgaaggaggcaagcctagagaaaagagagagtagagacatggagggaaggggttcgggggttcttaccttccagaaaagcgggaaaggggtcagcgcgcagaaataaggggttggggcacagagacaagaggttggggcacagaaataagggattggggcatggaaataagggatcggggcacagagataagaggtcggggtatggaaataagggatcggggcacagagataagaggtcagggcgtggaaataagggatcggggggttcttgccccccagaaaagcaaagaaggggtagaacacggagagagggagttgggggattcttgtaccccagaaaagtggtacttgctgctaagagtgaaggaccaaggcaggtgtccctgtgtggtcagacacctctgaaatgtgggtgaatgatcagagaggcatccctgcaatgattaaacaccaaaggaaggctgccttcccgagtccatgaccggtgccgggattttgggtccatggataaaacgtgtctcctttgtctctaccagaaaatgaaaggaattgaaattaagagaagggagagattgaagtgtggtgccaagattgaatggagaaagaggttgagggatagtgagggaggttggagaagagagtaaaaacaggctgcttagcggatttaaaattggtgagatgttccttgggctggtgggtctgaggacccgaggtcataggtggatctttttcacggagcaaagagcaggaggaaaggggattgatctcccaagggaggtcccctgatcctagtcatggcaccaaatttcatgtgcatccatgtgaagagaccaccaaacaggctttgtgtgagcaacaaggctgtttatttcacctggatgcaggcaggctgaatccgaaaagagagtcagcaaagggagataggggtggggccgttttataagatttgggtaggtaaaggaaaattacagtcaaaggggggttgttctctggcgggcaggagtgggagtcacaaggtgctcagtaggggagcttttgagccaggatgagcccggagaaggaatttcacaagataatatcatcagttaaggcaggaacaggccattttcacttcttttgtggtggaatgtcatcagttaaggcaggaaccagccatctggatgtgtacgtgcaggtcacaggggatatgatggctaagcttgggctcagaggcctgacagtcacattcagagctactggggcttaggcattcacatgtttttcatatgtttttggtaggacacttgaacccataacactctcttgagagtttatcatgaggattgaatgtggtaatgcatgtaaagctgtgatcacagtgcttggctggcacttcattccataaattacttttgaaagaaaaaattggctgggcatggtagctcatgcctgtaatcccagcactttaggaagcggaggtggaagcatcacttgaagccaggagtttgagaccagcctgggcaacatagtgagacccctgtctctacaaaacaataaataaaaatggctgagtgtggtggcacacgcctagtaaatcctagctccatccagagactgaggctggaggatcgcttgagcctaggaggtcaaggctgcagtgagctgtgatcacaccactgcacaccagcctgggtgatacagtgagagccagtctcagaaaagaaaaaggaagaagctgagcacctggaaattagatgctctatgtacattgtgtgccaggccccatttaagtgcttgatgtgtattatcccaccaaatcctcacaaccacccctcaagccaggcaaggttttcatttaaatgatgtggaagctgtgactgagagaggttaaggcatttgcctgaagtcacacagcctaagtggcagagctgaggatcagcctgaagcctatgaggctccacctcatcacactacataggactgtgctgtagtgtggagtgggggctgcttggaggggcagaaagccagggaggaaatgctgagcacacagcacacaggccctggggggctttctgggtctgagggacctggaatgagtctctgcgatagtgagaggcctagctgatggcaggctgcctggggaggtgctggcgagctgccagggtgcagggccaacaggtctgagccactccactgtgacctaaccggcctggccgatactgcaggtggggggctgggacagggctcagccgggggtgaggaatgttgccctgagcgtgggtacactcacttctccaggcttcattctgagtatacgcgcggctctcccggaagcgaagagggcacttccttacagaggcttgaaagtgtggtcatccaagattcaggccactctctcttccttcctgctttcttctgaaaggttccttgcacctaaggaaggtaacaatgaactatgttttcagtctggactagaagttcatttacccaggtactaacttgtttactcactcaagcatttattcattcattcactcatttactcttccccccattcacctaatggctcactgattcattcattcactcatgctctcacatattcatgcccacagccattcactcttccacctacccatccacctacccatccatccatccatccatccatccatccatccacccatcaaaccaaccatcaacctcttattcaattgccttcccattcatcccttctctcatcccccattttcccaaccaatctttcattctttcttccatctatctatgcatccatctatccatccatccacccaacctttattaagcacctaccatgtttcccacccaaaactccctatggctcccaaagtagttctgcacccacttcggctgacaattcacctacatattggaccccagctccttggcctcacagtggcatggttcccttgtctcctcctcaggaggaggctcaggagaagtggatgggtggtcttctgcacagccctggtctgcaggttccagccagtgacagccacctgaaacttggggtttttcaggaccctttgtgttgcgaggcctttcccgtctttaatgccagaaccatgcatgctcctgggctctatggctcccgtggggccctgttttcagtttcttggggcccatttcttgcctccctaaggccagaacagagcttcagactgtggggacccatagacttgggggccctccttgatgaggactctggggcctctcttcttggagtacaggtgaatatgcttcctggaaagattcactgacacccggaggcttagaggagggcagggcgggcccgggcaatctggggaagtctatggcattcagtcctggccagagggcaagagaaggggctcatggtccaaaatggatgcagggaataggacaccgccagggaagctggcaggagcgcttctcatacgttccccaaatgccctactgcaacaccttggcttgtgtccttgttggcacctggaaaccccttcccactccccaccctgacactcagcctctgctctcctctcagctgagtccacactctcctgctctttgctttcagacactctggtcgccttcccccagggcccctacagagctccataaagatttgctaagtgaatgaatgagttctcattttacagaagagggggttaaattccctgggttttccccttacccagcctttccccagctagttcctcctcctttacatcccagccaaaagaccaatcccgggaggctctccggacgccccctcactttgccactcccatttcctgctcccttcctatcctcccgcccccgtgcccaggtcctgctctctttacaccctgacatcttcctgcttgcttttttcctgtctcctggcaaatgtcaccatccccatttcacagaggaggaaaccgaggctcagagaagcctcagagggaatagcccagccagataaaaacccctgggtcgtgagcacgttcttccacccatagtagccaggtgctttattcatgtggttttactctgaaatcgggatggctgtaggtaataatagtggccatgcaaatcatatttcatgacagtttttgaaaggcgccgtttccacctcgcagttccagtgcaggcgggtgggactcagtggtgtgtgtgtgtgcggcgagtgcctgcctgtaggtggccccggccaagccagccccgccccaggaggaggctgaacattagtcctgcatgagggtgtctgggaactgggtgcgccacgggggccctacctcactcctccctctcacattgccgatcgagtcagccccacggcggcagcaccacgaccgaccgggatcctcgaggtgccagcccatggccgagcctgccctcctccccgccgcccagatggagaggctggccccagggcccctagcctcaccgtgtcctcggatcccgcgggcccgcattgccaggcgctgcgcccagcgctgggccgacctgggctgcaggtacaggggtcacgggagcgggagggaagttggccctactatgcaccaggggcatgtgcggtctgtcttcacaacatccctgtgaggcaagaatcttcctccatcgtacagatgaggaaacagaggcttggagagcccggtcacctggctgtcaagtggtggagatggcttttagccctagtccatgggactccaaacccagagccttcctgggacacagcattgccctgggttcaggctactggcctcctgcaggggtcactgattttcagattcttagagaccgtgagtgacgccagtatgtgccatttcctcttcctctgggtgtagagtcttagggggcccaggggctcaagattcaggagtctctgggtcaagtttctgggtcagtgtggccgtgtggtcacctcggctgagaactggtcaccccttattcctgctcagcctgccactgacagccagaccagaattttcaaatagtcatttcccccactctgattacatcatattacaatttgattattatagaaagtcaaacagtgcaggaatactgtacaggaatacatatgttcattcttgaaaacttactactgttaaagttttgacatataccttgggagaactttttgacatatgtaaacctaaacttgtatagttttacacaaataggctcttgtgttacatgtgcttgtaaggttttcccctgcaacccctcaattaatgttatggacatatttacatgtcagtaacataaagatccaattcattcactttagtggcctgccaggatccaactttatggatatctttggttaatttgaatcagttcctggctaatggacatttaggttggttccaatttttaacgattctaagcaatacagcaatgaacatctctggggacttgcatgggtaaaattcacatcctagacttgtagttgcaagtttaaaaggaatgttagaatctgaatagaccctgccctccaaaagtgttctagcttggaacacacctgcagcaggagacccccattgccccattcatttgccacccaaggacctgaagactagacgtggtctgtactcagaaagcagattcagggagcaggtgatcctgatcgtaggacaactgagtcctagaattcccttaagggaacaacttctaggctcaggaaagggagggggagcttagtgagaccatttcattcatacagcatgttcgctgagctcctatgtgcgtggggctctgccccatcacaggcaaaaattactcaggataggattttaataagaatcaattttaagaagccaaagacaagtttgtttatctgtctatctatctatctatctatctatctatctatctatctatctatctatctatctattctatatctaatctatccatctatctatctattctgtatctaatctatctatccatctatctattcatctatctatgtttcctattgctgctataacaaatcacataagcttatctatcatctctctctctgtctctctctctcatttatattagttttctattgctgctataacaaatcacataaacttagtagcttaaaacgacacaaatgtgttatctgacagttctgaatgctggaaatccccaaatcgaggagtctgtaggggtgcattctgtctgggggctctagcaatctgtttccttgccttttccagcttctgcagctgcccacattccttggctgatggtcctcttccgtcttcaaaggcagctctgtaacatcttcacacatctctctgactctgacctccacagtcatccccatgtctccttctctgactctcctgcctccctctttcattgataaggatccttgtgatgacattgggcccactggctaatccaggatcgtccccccaactcaagatccttagcttaatcacatatgcagagtccctttgcctgataacatatattcacaaatactgaggattaggatgtggacatcttggggagctgttattcagctgatcacaccatctatccaaccatgcgtcgtccgtccatccatctatctacctatctacctacctattatggctgttcccctgactccaccaccaccctcccttaatctcctggttccttgtgatctttgaggcaattaatattgaattcactataagagctcgtgacccattgaatgtgcttaatagctactggttgaatgaacagatgaaaaatacttaagagagtttaaaatttgaaccattctgtttattactgaaaacaaaacaacaaaagcaacatttttacttccagaacagtggtgttttttttttttttttgagatggagtctcactccgttgcccaggctggagtacaatggcacgatctcggctcactgcaacctccgcctcccgggttcaagtgattctcctgccttagcctcttgagtagctaggattacaggcgtgcgccaccacgcctggctaatttttgtattttcagtagagatggggtttcatcatgttggtcaggctggtctcgaactcctgagctcatgatccacccgccttagcctcccaaagtgctgggattacaagcgtgagccaatgcgcctggcccagaacagtggtttttaaaccagggttctgcaaacattttatttgaatttaatttttattatatctttcaagtattaaacatctagtaaaaatactacctccactcaggtatcccaaatgttttttgtcaactaaaattatcttgattgtatgatcagtaaatgctttaaattaaacttataaaatcagcttataataatatcaccgttacctcttttgtttattgagaagacattccactgccaaagaaaaaaaaaaaagcgaaaactacttccctggaacaaggttggtctgtttgctccaggctaatgttcttgtgtattggctcacaaggtcactaggtcagctcccccaatcctttgagtctgttcatctcactggtcccttgcttgtgagtcatttagttattcaacaaattccagcaggacggcaaccttcaggatgtaagcccggatctgttctgtttacccacagctctccagcactggcacagggctggcttgttgtaggtgttcatgaaatatttccctgatgaatgaaatgctcactgcctctacatgaagtcctgtgatggatatgagggtgtgggcatgaataagatgctctctcagcccttaagatgtccacaggctggtccaggaggaagacataacactggtcactaccacataatacactaaatgctgacctgaaaggcctgagcagggatgaatagagtcaatgttgtcatcaaacagaacatcccataatgtgagggggacaccgaattcactgtctatgtggacttcatcttaaaaccatgcaatattggccttgggaggtgcctcaaagacccagttggagtgaggtgactctgttgggattccccttatccttgctccctgtagaaatatattttctgttaattcatgattggtataaaaatgcaaaaaaagtagcaagtgaaatccacctgcccctcccacctccaacccacaagaacagcaattgtgagaagttaagtgtacatcctataggattttgtgcttcataaatatttacatacatgtatacgtaaaatgtatctatgatccaatccatgcacataattgtacttacatacgtgaattggtttgtattatgtatactattttataaatgacatttccatctttataatatcttttcctggaaagacatagaaatcaacattattctttttttttcttttggagacagagtcttgctctattgaccaggctgaggctggagtgcagtggtggaatcactgcagcctcaacctcccaggctcaagtgatcctgggaccacaggcatgcaccaccacgcctagctatttttttcatttttgtagagacagggtctccctatgttgctcaggcttgtctcaaactcctggactcaagcaatcctcctgcctcagcctcccaagtaggtgggactacaggcatgtgccaccacacctgcccttacgttatcctctttaaagactgtgtgatgtttcattttatgactggacagtacttttgttaactagcctcctgttgatggaattttaggttgcttctttttctcttttggttgctattataaactatactgcaatgttcttggacatatatctttgtgtacttatgatacattttcagaataggaatcatggagtccaaaggtgtatacatttaaaattctgaaacatattctgggtggttttccaggaaggttgtacccaattagactcaccaagtgggtgtgagcttgtttcctaatatacatgacattcttgaccagacattattgttcatttttagtcttggctaattggattgggagaaacctgtctcttgttttaatttgccctttttattattattagtgaggctgagcatcttttcacatgctcagtgtctggcagagttcaaaggcagatcagagaggcagaaagacccattttgagtctagtgcaccagccagatttccttaatcaataatgggttaaatgacttggctgattgcacacagatagcttgtagaatcaatcacctttacaaggttcaccttcactcatattttgctcatgtgtagctcaagtctctgccactggggtcaatgtcaactgatctctccagacacacccccttgtatgtgaacgcaaccactgaataaatcacctacacatggtttaaatatgtcaggggtagaaggacagcctgaatctgaaagcccagcttcaccacttatcagctgtggacctctggggaagttacttaacctttctgagccttggttccttttctgtaaaatggttgtgaacagcggtacctgcttcatagacttgttgtgaggataaaatgacattaatgcatgtgagggcttagtacagtgcccaccatttagaaatgggacaatttgtgtcagatatcagtggtcaaagggcaagttcttggagctgactccaaatagcacaggcttgttttcatgggacaagtacattcgggactcctgactccttggcatagcagaaaaatttgcatttgagtcctaaatcctccactcatcattgggaaagttccttcatttctctgggcctgatccttcatttgtggaatcagtgccattcagatagtggctgccgttcacactcacacatcctcctggttcgaaacccggaacggccacctcagatccgcagctcaggggaccaggctgccgctgggggcttctgaccagctttgcaggaaaaagtccttgcaaaccactttcctccagggctctccagcaggaggggcctcctcagatcctgcttacaaaccagcgaagggcaggtcccttcggatggagcttcctattttccctcttttctcacaatgaagcagaggtgaaggtgttaattacaccaagcagttaggctgccgcccttcacaaccctggggtcctcaccctgcctgcaatgtggaggccgcttctccacctcccctcctgtcaggcgtcaccgactcttcccaaattgaccagcagatgctcatccaagtgtgagaaggtcttttctcgatacttgccagtactgagtgttggcaatcttttctgtgtttgccaatctgatagagttcatccttgttttatttcgcattgccctgattacttgcgaggctccacatcttttcacatagggcatttgcattttatctcctgtgacttgtggatttctatctgctgccaactttcccagtagattttttgggtattttttttcttgttgctttccaggaactctttatatatatagactgaatagtaacactttatcatttgttgcagatatttcctctcagttgaggaaaaaggtcctatgacattttttatagtgtcttttgtcatacaaaagttttaagtcttgatgtaatcaactcagctttcttctgttatggcttctggattttaatttgtttggagagttgttctgcactaccatttatttcttactgactttgttctcattaaaccctaatacagacttctatccacccagggaaaactttgcacttcccagcataaagacctgctccccttcctgggagatttgcatatctcatttcctcccagacattcactgacttgtttctttaaaactgagtttcaacaccacctcctccaggaagcctcttctcagcccactcccccttttgttctctagttactactctgtcccctcgggctgtttgccccatcttaagaggactgttggctgctggctgctcgttggtcggaaggcagccttgtgttttcatgtttttggagtacttactatgggctgaatgttttacaggccttactttatttcatcctcactgccttctgtatactatcacacaatcaccctgattttataggccgcacatcaagaggacagacctaggcccagacagtgtgacttcagggccttggtccttagccactatagtggctaaggtgacttagggccacaaatttagtggccctaatttgggccgttggggcggtgaaaaagggccacaaatttagtggctgaaacaatacaaaggtattatcttagagttctggaggtcagaagtccaaaatgggtcttactggtctaaaaatcaaggtgtcggtaggactgtgatcctttctggaggctctcggggacaatcaattttctagcttcaagaagccacctgccttccttaagttgcggtccacctgcatctgcaaaggcaagagtggccggctgagtccttctcatgctaccatctctctggttttcactcttctgcctccctcttccccatttaaggaccttagtggtttcattgggcccactcaggcaacccagaataatctccccaaaatcagctgattagcaactgtaattccatctgcaaccttcatcccacctttgccatgtaacacacacatttacagattccagggagtagtgggtagtgggggggttattctgcctacccgcagtcacccttccatattgcttttccaaacttcagtcccctgcctccaccctcaggagtcatcctgcctccctccaacctggggcttagatcagtgccttggagtcacctggaaggcttgtgcaaacacagattgctgcaccccacccccagagtttctaattctgtagttctgaggcgagggctgaaaatgtgcactcctaacaggctcccaactgatgctgatactgaaggtctggggcccacactttgagaaccactgggttaagtttattaatccttcaaatatttatcaatatctgctctgttttgggagctgggcttatacaataataaaaagaatgtctctggtctcaaagagatcccagactaaaggagaaaacaaacaggcaatgaccatggagggcggtaagtgccaggacatcaatgagcccaacgcctctaggagggctgcagagaaggcttcctggaggaggtgatgcctgagctgagtcccaaagtaggcactgagcaggccaaggatgggaaggagaagggtgttcctggcagtagctgccaactgggcaaaactccagggcaagagggagcctggtgcctctgagaggtacacgtagctcacactggctggagcagagagtggggcagaggagagatgggattgcagtttgctttcaagccctgagcccggctgcaaccccagggccaggagacctgaaggtaggatgacaatctggctcttaagcccttgagtgcgtaatggaagagtgagcaatgaggacctccctgtgaagatgtgcagcaaagacagggataatgaggccatgcctcacccctaggccagcctaagaggaggtgtaaccatggcaaccagcctgatgctcttcctgctggtcttttttgaaggctttaaagaccagatgttcttaatctggggctcaaggatggaccttcaaagatccgagaaccactaaaattatttggtaaatgttatgcatctctgtgtgtgtgtgtggttctccggagagaggatccacaacttacataagattttaaaaagctccccccactgtgccacccccctaccccaaaccagctaggaagatgttatagaccaggagttgtaaactctggtgcctacaagggttaagtgggaccctcagggagtcacgtggcagagtgtaacatctcagggcatggtgaggattgtggaaccaaggtgtgaatgggaaaaccaagctctgtaatatattttaaggtttattctgagccaatgtaagagaccctggcctggggaacacagtctcaagaggtctgagaaggtgtctccatggcagtcagattacagtttggttttatgcattttaggggagacaggagttataggcaaagacataactcaaagcatagaagctgtataatggtttggctggaaaaggcggcatatcttgaagccggggcttacagattatacgtggattcagattctttaatttgcaattggttagaggagtgaagcttcgtctaaaaatttggagtcagcagaaaggaatgtttaagagaaggaagtctgttaaccaatataccagttcagagttgctcgtaggggtgtgtgagttcacctttgtctggcacagccataggtcctgtttataattggttatcttattgtcacaaaaagtctgttttgtcaatcttgtgatgtcttttctttttttttttcttttttttttttttgacagagtcttgctctgtcacccaggctggagtgcagtggcaaaatctcagctcactgcaacctccacctccggggtttaagcgattctcctgcctcagccttccgagtagctgggattacaggcacccaccaccacacctggataatttttgtatttttagtagagatggggtttcaccatgttggccaggctagtctcgaactcctggtctcaagtgattcacctgcctcagcctcccaaagtggaggcaaggcgtgagccaccatgcctggccattgtgatgtctattttaacattaatgctggtcagatgctgtgcctaaactacaaaagggaggagcgtataatgaggtgtgtccaacttcccaacccatcatggctacgaattcagttttgcaggtttccctgcgattctcttggccaagagagtggatctgttcaattggctggggggcttaggattttatttttggtttatggagggcactaagcctatttaaaactttttttttttttttttttttagaaacagggtctcactcttttacccaagctggagtgcagtaacacaatcatagctcactgcaacctcaaactcctgggctcaagcaatcctcctgcccacgcctcctgaacggctgggactccagttatgcacaaccacacttggctaatttttttttttcagacggagtcttgctctgtcgcccaggctggagtgcagtggcaccatcttggctctctgcaagctcccgggttcacgccattctcctgcctcagcctcccaagtagctgggactacaggcgcccgccaccatgcccagctaatttttttgtgtgtttttagtagagatagggtttcactgtgttagccaggatgatctcgatctcctgaccccgtgatcctcccacctcggcctcccaaagtgctgggattacaggcacgagccaccgtgcctggccacacccggctaatttttgtaattttttttttgtagggatagggtcttgctgtgttgcccaggctgatttccaactcctgggctcagatgatcctcctgcctcagcctcccaaaacgctgggactacaggcatgagccactgtgcctggtctaaaacttctaatatgatcaaattaacaacattaatacttaatgttattttaataaaaacaacattttatgtaacccaatatgtccagaatattttcacatgtaatcaatatgaaacattaatgagatattttacattttcaaatatgaagtcttcaaaatccagtgtgtatttttcatttccagcaatctctgataggatgctaaattttcatcagaaatccttaatatatatttagatttcataaaatatacagccagaaaagtagatttgtgtacccaagttgttctaaacatatttaggccttttccagtaactgaaacaagtatgtagttttaaatttaaattggttaaaattaaataaagttggctgggcacggtggctcacacctgtaatcccagcactttgggaggctgaggagggcagatcacttgaggttgggagcttgagaccagcctggccaacgtggagaaaccctgtctgtactaaaaatacaaaaattagctgggcatggtggaaggtgcctgtaattccagccgggaggctgaggcagaagaatcgcttaaacccaagaggcagaggtttctgtgagctgagattgcaccactgcactccaacctgggcgaaagagtgggattctgtctgaaaatgaaagaaaagaaaagaaaagagataagaaaagaaaaggaaaggaaagaaaagaaaagaaagaaggaaggaaggaaggagttaaaaattcagctcctcattcatactaaataccatatttcaagggctcaggtggctagtggctacaatattggccagtacaaatcaagatgacaatctaagtgactcaggaagggacacacaaatgtctataatcttgttcgaaggaaggatcagggaaagcctacacaacttaaggactttcgaagcttctctggcaagcaccacagggctgcgctgctggctggaggcctgttttaagaggcagccaccacttggcttcagccaattgtcacttagagacacagacccaggattatcatctctactgattattttttcccaagggaaattggaaattagaggacttaaaaatgtgagacctcctcattttcaaatgatggcaagctatttaaaaggtgtgaaaatccattgtgtgtgttggggacgtggtggggggatgcagtttgctatctcagatggagattggtagatcctgatcttctgttgggaatatttgtcgtctcagaggtcatgggcagtaccttaatctcccccatccatctaaaaaatgcaggctgcccctcccagagtgctatgtgagaattctgatgcaatccatcagttcccacccaactcttgaaacctatgcaattctctgaaccccagcaacataatgatactcctggctttccaaccctggttgcacaatggaatcaacaataggtgcccaggtcccattcccagcagtttgggtgtcattggtctggctggggcattgcttgggcataatggcctggcaaagcttactgggagattccagcccatgggcagggtggagaagcaccctgccctggagaaggtctctgggccaggtctccacacctaggatgcagcttcttgggcccagcgtgggtcctctgttctgatttgtgcccaacttgaacagctaaagggggcacccatagctgtgccttccctgtctctcagcccaggctcctgtgtgattcaggaagctaaattatattaattacatttcagaatgttttattcttgttgtctataacacaaaatagccatgcttgtgactttcataacccacagatcggctctagcagaaatgctgtgtgaaagagatatggcgagcatcgtttaataattcaaagaatggtcacactgtccagaatgagccagtcttctttgtcttaatgggaaagttgtagccatagagggattttaggagctcagttaagatgatactcaaaaatgtaaaggtaagatttaccttttataacatctcattcccacccatcccaaccctgttgccacaggggttgcttcgtagatgtgagtgttgctgtgtcccgatgttcaggttgtgcactgcatgtgagtgttacactcagaggggcaccatttacgtagtcatcatgtactaagttatgtgagtgatatgggtaggcatgaagaatccagacctcctggcaagtcctgaggcaacagaggagagaccctcttcataggcacacatggctatgtacacattcatgagtgactgtgcacccacgattccctggcgtacccatacacacatggctgtgccctgagattgcctttctttctttctttctttttttttgagttgggtccatttttattgtggatcggggcttagagcataagcactggtcagcatcattagctgcaccatctaccatccttctctgtgacccatctctataggagcgtctaaatttagcccaagaaatcaggatcaagaagggggaaaaaaaaccattggccacatggccactcctgctatatctacacctaccagtcactgaacacttacccaaggtgacggtttccatgcaggagacccaagcggctctgctagggacaataacttatttgcctaaagcttttttctttctcaaaagagggggcagagaaggctgatttctagaagtagatgtggaattgaagaatgtcccagggagctaagttttaaggactagccacaaacttgttgcttctccaacaatgtcatgaatccattccttgcaccatcgcacgtttttcatgcattcaaaagtgtctctagagctccagaaccatgagtacctcatcacgtcctgagcgtcacatcccccagcaagctgcctgcaccaggcctttctctagaagtcctgagactgagtactctccgaaggctggaggtttgtgcgagtttgtacgtgtggttgagcgcttgtgtgaggaaagtcccgctggggttgatctccatcaaggtcaagttatccggcttggcatgtgcctcctgttgcctcacaaagctgtcagcagacactcggagtttggctatacgagtgtcccatatatccttgaccagggtccggatttcgtctgccttcgggatgttgtctgaagcatgatttaatgggagcttggtaagttccatgtagtaaaggctggtgggcattgaggtaaaaaagtttcttcctttcattcatgatccctcatcttctccaacttttctatgttcatccactccggagggagcagtcgacatttctgcttttgtttcaggttaattgccagccacgggggtacttccactggtaaaccagggttaaaaggccccaggtacccaccccaatgaggtagctcttgtccagactgaagttggggataatggtaaccagctccttctcagccaggaactcgacctcggccacgtccatggcggcgcgagtggccagctcgggcctcacagtctccttgggcccttcagtgtcccggaggaggtgccgcagccactgttttccccgagattgcctttcaatctctgctctaagaggtccaatttctatcctttattgattcctgactcagaaccggatgtgtctctttatctgggggttggagatagggtggaacatggagcgtgcacacagccagtggcgtgtgcacctggcacctgggaatggtgtgagtggcagagagtgggctcaccgcacctctggcagagctgctggggttgtgcgatagcgtgctgtccctgtcagctatcactgtgtgacaaatgatccccaaacccagcagcaatcatttccctaagcgacgattgtgtactcccgctcctgtgtctgaaggtggctggggattagttgctctaccctaggctctgctgggcagctccatttctagccatgggtctggctgaacttactcctccctgcttactgggctgtggtctgtgccataggtgttcattctgggacccaggcggcagctgtccagggacggctcttctcatggtgttgatagcggtgtgagagggccaccccaccacccaggcacattgcatacctgggcttgcccagagccaaaggcacatggcatcccacacagccactccctgatggtggctagctctctcacccacctctctccctcctttcccttcaccccaagcttctcaccttcccccagattccctgctcagcaaagtaaagcttggcactgcccaacagcggctgttgctcttccagccttccccactggggacaatctcaattcattgctccacaacatatcattacccaacaacaattatgggacaagagatacgttcaaaagagtccaggaactctgtggctcaggtgatagggataagagctcagctgatcagaggcagagctggggctacatctgggctggtggtattccctcaccaaccacaggctgcatccagccagtgaaagaaaagaaaacattcacaattgaggaaagaccgttgtacaagcggcttattacacagtggttgagaacatggactacagagccagacttcctggggccaaatgcagttctgccatttactagtcaggtaaccttgcagaagtcactttatcgctgtgcctctgtttgaccatctgtgaaatgggatgataagaagttgtgaagagtaaatgaattaatccatgctaagcagtgtttctcagccagaatgatggtgttccccagggaacatttggcaaggtctggagaccttgtcattgttaaaactgagagggatgctttggcgtctagtgggtagagggcagggatgctgctaacttactacagtgcacaggacagccctccttcacagcaaagaatcatcctcctgacatgctgttagtactgagcttgaggaactttatttatttatttatttatttattttgagacggagtctcacgctgttgcccaggctggagtgcagtggcacagtctcggctcactgcaacctccacttcctagattcggtggaactgaaggctgcccccaaagccctattcaccacttttgggggaagcccttggctgggttgctgaagccaggccacgctccctgccccagcaggtccaggctgagctgacctggtttggctgctggagaggaggctcagccacacctccaccgactcatcccgatggcccgcattcttgctccctcggtcatgctggctttcggcttccctgaacaggctctcggcttcgctgagcaggctcttgcttctgtggctctcagctttacatgggtttctgcagccctgcccttgggaaaggcctttgctccactgtcatattattctcactgcctgctatgacctcacgggcaagggtctcgctaagatcaccttgcaaagcccccttctctacccctgtcttcccattttatggacttggaagctgaggtccatcgagaaaaagggacgtgcccacagctgcacagaacatgagcaggggagcttggatgggagccgaggacttctaggacctgcctcatctttcaggccacctagggggaaagttcatgtgtgtggagagaagggctttgcattcaggaaggctctaagcctctgtgagggctccggccctctgactcactgcaggaatatatttcttcatgctctgtgcttgtaagcccctgcccactctgcaggacaggaactagaggccactcactggctgggcagtcttgggtgagccacttgctgtgtctgaatctcagataggaagagtccagaagcaacatatattgatcaaactaacattgactgaggacttcctattctaagcaccttaggtgtattagcttcctagtaactggccatagtaagggctcgataaacatttgctgaatgagtgaattggctcttacactacactgccccaggtagtctctgttagcttcatattaaaatgaggaagctaaggtccagccaggtttggggactccccaaggtgacgttgctaataaacaacaaatctaggattcaaattcagacccagttgacactagagccaaatttcttgactttttttttttttttctgagacggagtctcacattgtcacctgggctggagtgcagtggtgcgatcttggttcactgtaatctctgcctcccaggttcaagtgattctcctgcctcagcctcctgagtagctgggattccaggcgcccgccaccacgcccattaattttttgtattttttacaaaatacaaaagagacggggttcaccatgttggccaggctgttcttgaactcctgaccttgtgattcacccacctcagcctcccaaagtgctgggattacaggtgtgagccaccgcacccagcccaaagttcttgacttctaaatttacaaatctgtttatctattgcttagtggcacataacaaccatcattttattccgcttagcgattcgatgggtaaggaattgggacagagcgggcaagaatacctgctctctgctccatgatgtctggggtatcacctgggaagactgaatggctgcgggtgacttcatgctggggactggagccatctgtctggaagtttctccactcatgtgtctgacacctacactcaaatgattcaagggtgaggttcggctagggctgttgactggggcacctgcatgtcacctggcacttggcctgagcttctcaacatagcaaccccttccaaggagcaagcagagagtgagagagccaggtgggatcagcttggtcactatgaccagacagagaagtctcatcgctcgacctctgctgtgtcctcttagctgaagctgtcacagcctgacagattcaaggggaggagacataggccccacctccccatgggaggactgtaaaagaattttgggaccatacgtgatatccaccacaactactgtattctaggcagtgttctaggcactggggagacagcagggaatagagaagccaagaaagaaatagttccagcagaaatgaatgtgttatggagaagcagatggcagagacgtaatccaggttagggatgagaaaggttgtatttgaggaagtgactttaagtctgagacaggacattccaggcagagggaagaaggaggtacgtgagacgaggctagaagcatgggcaggtcagtccaatgccttcgtaaggcatttggattttatcctcagggtcctgggataccatgaggattcctagatgcggtgaaaggccagtattgtgagcttggaagatctttctgaaccagagaagggtatctagacgaaacatgggaagactgcgatgaggctgtggtccaggcgagaagtgatggtggcttggaccagagtggtggttcagaagttggtggatagaaatgttgtatgaaaggtaacattcattaggggttcatgggatgtggagacaccaaaaagggtgtgaggagtggctctcagagtgcttgatggaaccatctgatgagacagggaactctgagaggggcacagtgtctacagtggggaaggaaaaatgcattcagattacttcatttacacctggggcctccctaaatcatctagtatggcagttaagtgccctggtagtggggctttcaacctgggttcgtatccgggctttgtcacttgccaatgggacaagtcttggtgggtcccccaatcccgttgggtctgtttccttgtctgtaagttggaaacaatagcacccctacatggcactgatgtattaaactgaggtttggccaggcttgatggcttacatgtggaatctcagcactttgggaggatcactggagtcaaggcatttaagggcagcctgagcagcatagcaagacctcgtctctactgaaatgaaaaattaactgggcatggtggcatgtgcctataattctagctacttggggggctgaggtgggagcatcgcttgagcccaagacttcgaggcagcagtgagctatgatcgcgccattgccttcgagacagagcaagaccctttccaaataaaaagaaataaactgatgcttgaacatgtttgcccctgggcatgtagtaggtattcagtaaaggtttgaaaaccaaattacaactggaggccacgctgtatacttagcacctgagtacttttctgcatgcgctatacctcaacaaagcgctggaaacaaaacaaacaaaacatcagctatatttgtgaggttctgaacaccttttgtggatgcgttctcttcctatcgttctcttcctagaagggggtactcaccgccatgctgcaaaatgtgatgttggaacaatgacacctttagcactgcgggtgtttcattttgtttctgttctttcccctctctgacctcctcagaatgttcttccaaagaaataattgctgccccctcactgcttagctatcaaatggtgatagtgttgacaattttgcttgggtttagtcgctgcagttttcaaattgtcacgaaaacacacagatgctggtaatttcaaagcgaatcgcaaagcaaccaaagaaacggagctgtgcccccagcatggggtgccaaacagattcgcaggaggcactgactggcagttttcttgaaaagcataaatagagcagaacagccaattttataattaactgggacttggtctccagtgaagcttctgctctgtgcaaatgccggagccgttgccaggaggttgtgccctgtcccttccttcaggctctggccgactggaggtttctttgctttaccacattttgagtctgtttcaggatggaattgtttaggactcggagttgagctctgtgtgggcaggacgcttgagaggaagccacaagccagggtctacggtaaaatcctggcaggaaaggccatgtgcagaaagaacatgggtccctcattcaaacattgttaagaattttgagatggtgacagcagttctctgaacgaagtgtgggctgcttccaaacctgggccctgtgtgactgcacaggtcgcacatccatggagccggccctaggtcctggattacacctccagaaactggggggacaacagtgagtgaggtcataggctgagggcaaaatacaacttcagggactccaggggatgggatcccacaagatgggggctaagcaggcagcaggggtaaaatcagaacaaacaaacatccaataaaatagtccttttttagaggcaatgtgataagagttcacaaaccctttgattcagcaattctacttctaggattctcttctactgtacaaaggaacaaaggtaacagatggtattatttgtgatattgatgaatagaaacaacccaaatctccatcaaaaggaaatggggatatttcaaataaatgcgctgtgtgggggaccttcctgtgagcatccagctcctcagcaaagagctatcaaatgcttagcatgcatgggactcttgtggggctggtggaggacttgagttctgtgtcttggctgacatgagcccaaaacaatgtcccctgagtgaagaagagagtgcctgcctttaggttaaatatgcctggggagaaacatgagatgtctgcacaccaaagtgttagcatggaaaacgtggtcgtagccacaggagaatgattgatattctactttgctcacttctgcattgctgggaatttttacaataactgcatattgattttataagggaaaatatagctaacaaaaatgttttaaggccgggctcaatggctcattcctgtaatcccagtactttaggaggccaaggcaggcggattgcttgagcccaggagttcgagaacagcctgggtaacatggcaaaaaccctgtctctacaaaaaatgcaaaaattagccaggcatggtcatgtgtgcctgtagtcccagctactcaggagtctgaggtgggaggatggcttgagcctgggaggcggaggttgccgtgagtcatatcgcaccactgcactccagcctgggccatagaaccagaccttgcctcaaaaaacaaaaacaaacaaacaaacaaacaaaaacagaaaagcacatatatatatattttttttttaaaaaggcagcatgtggatgacttttcctttttaatccaaatgagtcttgttttttaatagggcagttcaaaccacctatgtttattggttttctttgccttttgttggtttccacatgggagcttaaatatctatagaacttgcagaatatacatttttcccacttgaggaaactggggaaatggatttcttccctctcttctggcaggggtagtttatggtctatttgctggcatgtgtcagggtctaggtgattccagtctagtatttttgccattatgaccaaccctaccatttctcaaggatttgggccagcaacagggacattttgtccctaagctcatctgaagtcctggacttcatttatatggaccaggagacttgcactgtcttaccctgagattctttgattgcatgaagcagaaattcattgagtgtagcttgggaagaagagggggattaaagggaaggatgtgggagtcagggctctaggggtaaaccacatagcctggatcatgaaaggctgcaactgggacctggaaaatcaagcttaggttaccccacatccctccatgcctgcagagggtctcctctctgcttcttttggaagactggccactccagccccacacagcttccagttcacgtgcctgatactgacccctctgcccttggttcaacaccttgagagaatgagattggctcagtgatgtatagcacctctgtgatcaggtacctgctctgttcaaagctggctgggagaggggaggagatgaggtgctcctgtgatacaaacaggagacccagggcttggcagccagactcacaaaggaggaagtgtgagggaaggagacaggagactttctgggtaaaaattcagtgagatccacgagacactgccctgtcatttcctcgcctgtcctggtgtttaatcccctcttgggaatgctgcctttaccgtaggtatgtccaagactgttagccttgaccaagaaggtggaagcaagcagagcagtctggccctgctctgtcccctgcagcattgctggtttccaaggatcccgcaggggtgatgggtcaccagtcaatttgctgagatcaccctgagaaacatgcctaggaagcttgcttagcccccaggggcccaggctgatttctggagagccacaagcctcagcacaacccccatcataagcagagacttgctgacctccctgcaccttccccacttgctacagctctggcccctcctcaggccgaatggatcagcttccccagaagaatctcctgcgactacaccctgctggctctgctggctgttccactggagtggagagctccagcatggatggcttttggatggaggtggaacagatccaacagagagatgagctgagggaagaggacagtggcgggaatgaaggccagcttccagagggtgagagaccctggcgggggcctataggggtggtgggagggcttgattccaggcagagaaatgtcagaggatccagatatgaaccagaacatgacagcattttctctgttgcctggactggtgcagtatcctcttcactgctctccctgcttcacccgtgatccttactgtctgttctccatgccatagtcaagacgatcttttagtaatgtaaattagattatgtccctccttagagtaagtccttcaggaaatattttttgagtgcctattatgtgccaggcactgtttaggcactggggatacaacagtgaacacaaaacagtctcctatatacagacctaatgttctagggaaattctaagccctctgctctaaatcctcaaatatctctccatctatctcagagtaatagacaattatgtgtccctattatctactactatgtaacaaaccacctcaagcttagaagcataatgcagcaataatcaattattatgactattactatacctcactgttggaggggttgagtgggctcagctaggtggttcttgctcagggcctctcatgcagttacaatcaaatggtagctggggctggactcatctcaaaagatttctcatctatgtgcctggtggtggatgtgaccatcagggggcctcatctgggattatcatctggaatacctgcatgaggcctccacatgtggcctgggcttcctcacagcatggcggctgggttccaagcacaagaccaagagagagagctgggtagaagctgtcttgctgcttatgacccagctttagaagaaagacaacattgcttctgctgcattctgttaccctgcatgcagctatgttcaaggggaggggaattagactccaccccttgatggggtgagagtcaaagaatttggggacgtgtaataaagccaccagatcataacttaccaggctttacataattggcttcgtgcctcctctctgcctcttctcctcccaccctgactggctgtcactctacttctgtcctcgggcctccttgctggtccttgaccctaaaagcactttcctgcctcaagtcctttggttctctctgctcccttggcctcaaatgctcttgccccaggcatctgcatggcttgttctctccagtcaggactgggctcaaatgttacctcctcagagaggtcttcaccagcttccctacacaaaatagcacccctgccccatcactctctagcccctgccctactctgttcgttgctgcagcaatgatcactgcctgactttacctagtgcacttcactgtgcatgtgtctgtgacccccactagaatgtaacttccatgaggccagggacatcatcggcccttttcactgctgtgtccacagtgcctagaacagagccaagcacattcccctcctccatccttacttgttcagcagatgagggaatgaaagggctccacatggaacccttcctggtttggcatgtaattcagctgggcttgcccctggttggcaaaacagaccacgtggtgatgcagacctcctaagggcctaatagtctcatgcagtgcctccaagtgtaaatgtaaaaacatccctggttacactagaagtggtttcaggagatgccctgcataggaggtcctccatgtggcctctctggaatcatgatgtggccagcaatctaatttcccacaatacacagggagtggagtcagagtgggtcagagagaagccactttgagcaaccaaataaacacaggagcttttttagactcacagggctgagggatcctgagtggcatggagccaagactggtttttttttttcctttcttttctttttatttatttatttaatttttgaaacggagtttcactctgtcacccagactggggtgcagtggcacaatctcagcccactgcaacctccatctcctgggttcaagcgattctcctgcctcagcctcccaagtagttgggactactggcattcaccaccacacccgtctaattttcgtatttttagtagagatggggtttcgccatgttggccgggctggtcttgaaatcctgatctcaggtgatctgcccaccttggcctcccaaagtgctgggattacaggcatgagccaccatgcctggtcatcttttctttttattcggacaccaacttgaaccagagggattgttaataatttatttttcccatcaatgtctactcatggcaggtgatgttggatgctccatttatggtggggatcttgtttccttttaaaatagatgtgttttagtaaaaaatgtagcccatgattaaggggatatatttggtaaggaattttacagggacaattagatacagataaaaattataaaggtggttggtgaatgcctacatttcaagaaacagtggctcattgaaaggatcctgtacaaacaaaaaaatgtctggcatcatgatagaatcagtacctccaccagccagcacaagtcaggaatggacccacaacattgcaactgccctggaggcatctgttctggttcccaagtgcagggaaagtgttgggggaagacttggattatttgcaaaacccaggctgccataaaagcagttttgtttgagtttttaaaacacttattaccttgttgactaactgggtcaacactgggtacaactgtacaccccaccaatcctctcacacatgtgttcaatttccagtaagagctcttgtccatttcccccatgataaggccagtgtttctcaagtgtggtctgaagaccctattgcattagaataatctgaggaagacattcgaagtgcagattctcaggcccgaggcctgaactcctggaacagaatccctggaggtaagacccgagatcctgaaatctcaacacaccctcccattccagttaatggttttgctatgggactatgagagtttccttaggaagcacagtagaggggacaattccaacacaaataaggtcttgaatatggaggacttcccaaagggacatcaacacccagcaccaacttcccaaggggacaccatgtgaccctgtagtggtctctgccagattttggataagtgggttcattactttggagagaagtgggtccaaaatctgaacatgcagggcccttcacccacctctgttttccagggattgctatgttatgggttgacatccatacactggctaatgctatcagtaccccccaccccgcccccagttctcagaaggctcattagatcttctcccccggagagtctggttggtgttaataggtctcacgatcagatatgcagaaactcctgtgtccaggtgagtgtgtgcttctatgcagaactttggttagcacgagtggctgagtgcagagctgtgtgtgttcatctgggttctacttctgttggcagaaggggaagctgaatcccagtggctgcaggacacaggcctgtcgggcctccttggtggcctgggcttggatggtgatcaccaggagctcctgtccaccctgacacagacccaggtggccgctgtgtgccgccggctggacatctatgctcgctcagtgcgaagacaacacaagacacctgtcagagatgtcagggatgtctttggggtcttcaattcaggggtaagtggcatatgggtcattgcaggccccgtctgactgggatctctgtgctgccgccacagcctgagagatgcagtgatcctgctgaagggctgtgttggtgtgtgtatgtgtgtgttggtgtgtgggtgttggtatgtgtgttggtgtctgtgtgttggtgtgtgtgttggggtgtgtgtgtgttggggtatgtgtgttgggggtgtgtgtgttgtctgtgttgggggtgtgtgtgttggtgtgtgtgttttggggtgtgtgtatgttggtgtgtgcatgttggtgtctgtgtgttggtatgtgtgttggggtatgtgtgtgtgtgttggtgtgtgttggggtatgtgtgttgagtgtgtgtgttgtgtgtgttggggtgtgcgttggtgtgtgtgtgttggtgtgtgtgtgttggggtgtgtgtggggtgtgttggtgtgtgtgggggtgtgttggtgtgtgtgttgtgtgtgtgttggtgtgtgtgtattcagagtgcagtggcttgcacacgtatgtctccctgccttccactatgtccctatgttgcatgtaggtcttcatctcccatgcatgccactgcatatatgcctgttgccactgtgtgtccttgggtgagcctgaaagcctaggttctttctatataattgttattgatgcagggcaggcaagcccctaaattggggattagctctggaagcttttggtttcactcaggaaagaattcaagagtgagctggtggtagaagaaaacaacactatggaggcagcagtaatacagtggcgtgactgctgctgcagagcggggccacccgataggccgtgtccaggacagcagcccaggggcaggaccaccctataggctgtgtgtccagagcaacagctcaggagcagttctgccttttaattacatgcaaattaaggggtgagttattcagaaatgtctagaaaaggggcagtaatttccaggtgttgccatggcaatggtaaactgtcatggcactgtgggcatgtcttatggagaggtgtttttgcctcttccttgtttcagccaaagtcccacctcctacctcattatcagtacaaaatcctttttttttttttgagactgagcctcgctctgtcgcccaggctagagtgcagtggcgacatctcgactcactgcaagctccgcctcccgggttcacgccgttctcctgcctcagcctgccgagtagctgggactacaggcgcccgccaccatgcccggctaattttttgtatttttagtagagacggggtttcactgtgttagccaggatggtctctatctcctgacctggtgatccaccagcctcggcctcccaaagtgctgggattacaggcgtgagccaccacgcccggctggcacaaaatacttttttattgtcactgtgtatcctgctgacacttgaagcctgataggttgtgggcatcatctttcttggagcacctctgaagtggcatagcagtgattaaaaccacaggctttggagccagccagacttgggccccagtgcccattccccgacttagcagctgtgggactttgggcaagtaactcagcctctctgggcttcagtggctccatctgtgaaaaggggttgtgggtggcttctgtctcccagggttgtgtgagcattgtcagcttcccacatgagtaattgggcactgtctgtaatttgcatagaaaatgtcgtcagagaatggcgactccggtatgaagggggcccagctcagttccggggcctctaagtttcctccaggtaagtggtcttcattctccagggccctgagaatcctccaggctgcataaagggctgctctgtgaagtaagagaatgtgcacacctcccagcatttcctgcttcctgctgactccctgccttccctgctcaagggcagtagggaggagccctgaggggacaggttgggcccttaagtgagctgttgccatcaggcccatggggctcaagatgggaaaattctcttcctgggcaattggccttagctgggaaatcacttcctggggcagtgagggtcttagctaggaaatcatttcctgggggcaatgggccatagctaggaaatcacttcctgggcaatgagcctgagccctaaacctaatgatttgatcctggggctttgaacttgagcttgggagctcacttcttaggactaagggcctaagtcccgaacccaagcacttgcttcctggcagccagttctcactgcctttctctgctttgtttcccccgccccgcagcagcagagcctggggggctgcaggagcaggctgggagggaagaagccttcaacatggactctgcctactcagaacaagctgcggtgctcctgcagaggagcaggccatcccggggaggcacctctgcctggggcaagtgttccctgccggtgaggatgctgtccacagggctggttggctaggtccccctgtgctcaggcaccagcacccatctcttcacaccttccacactgacaggcatccagcacaaaagttgttaattcattcattcatttaattcgtaccacaaatatttactgagtgaccgctgggtatcaagactggggagcaggatgcttacagtctaacagtcctgtcagtattgtctccatgctctttgtttttatccttagaaagccctccctcctccagcaagctcataactgtccatcaacatgtttttctagttacttttaaaattaattttagtgcctggagtgacagagagagacccaatattttagttctgttctttcctccctctctccctccctcccttccctcctcctcctccttcttttttctttctttctttctttctttttctttctttctttctttgtttttcttttctttctctttctttcctttctttctcctccctccttccctccctccctcccttccttccttccttctttccttccttccttttcttcttcctttctttccttctttccttcttttttttttctttgagacaaggtctcactctgtcacccaggcgggagtgcagtggtaccatcccagctcactgcagcctcaacctcccaggctcaagctatccttacacctcagtctctcaagtagctaggactacagttgcatgccaccatgcccagctaatttttaaaattttttttagagttaggttcttcctacattgcccaggctggtctcaaactcctgggctcaagcaatcctccagcctcagcctcccaaagtgctgggattacaggtgtgagccactgcacctggccgttcttttttcccaaaatattcagttatcccagcatagttccttccaaataggatgtaatcattgatagttaggtttttaaagattgaactataactcgctgttaagtgcacagatatttaccaggtacagcttggtgtgtatgcccgtgtaaataccaacaaatgagtacagaaacttcctcccttgcttgatggcttgtaatatggaaaaagaaagaaagaaagaaacttcctaccccaccaccccctcagtgcccgcatgcccttcccaggtaattcctttccctgcagaataaccactattctgacttctctcatggagtaaatatagtctttcacagtccctctattactaaaggaagtgtttcttctttgaccacgtgatgatgcagtcgatgcaatcttaggtaacattttactgagggctgccctggcccagggcattgttcccaaggcttccagtgccctcattgctccctgactatatgatagaaagaaagagaagtaggatcgggcacagtggctcacgcctgtaatcccagcaatttgggaggccaaggcgagaggattgcttgagtctaggagtttgaaaccagcctgggcaacataacaataccccatctctacaaaaaatttttgaaatagccaggtgtgatggtgcaggcctgtagtcttagccacttgggaggctgaggcaggaggatcacttgtacctggaggttgaagctgcagtgagctatgattgcaccactgctctccagcctgggccacagagcaagacctaaaaaaaaaaaaaaaaaaaaagagaagtggcatatgttagtctgtttttacactgctgataaaggcatgaaagaggtttaatggacttacagttccacatggctggggaggcctcacaatcatggtggaaggtgaaaggcacgtctcatgtggcagcagacaagagaagagagcttgtgcagggaatctcccctttttaaaaccatcagatctcgtgagacttattcactatcacaagaacagcctgggaaagacctgcccccgtgattcaattacctcccacagggcccctcccacaacacatggaaattcaagatgagatttggcgggggacatagccaaaccatatcatggtgctcagagaggagaagtgacagaattggctcccacaaaggccaggacaggaacacctggcagcctgaccctggagccttcccaactgaccaccactctctactgcttaggaaaccaaccccaccccctgcagtagcctctattccaatgtgagagtactttcactcattcaaatggaattttcttaggtccacagcaagttgcaaaaacagaactcccacgtactctgcacctagtttctcttagtgataatattttccattaatcatagtacatcaaataacatttatatttatttatttatttatttaattttttcttttttgaaacagtctcactctgttgcccaggctggagtgcagtggcaaaacctcggctcactacaacctccacccccgacgttcaagtgattgttgtgcctctgcctcccaagtagctgggactacaggcatgtgctaccacacccagctaatttttgtatttttagtagagacagggtttctccatgttggccaggctggtctcgaactcctgacctcaggtgatctgcccgcctcagcctcccaaagtgttaggattacaggtatgagccactgcacccggcctaaatttttttttttttgagacggagtctcgctctattgcccaggctggagtgcagtggtgcaatcttggttcactgcaagctccgccccctgggttcatgccattctcctgcctcagcccccgagtagctgggactacaggcgcccgccaccatgcctggctaattttttgtatatttagtagagatggggtttcaccgtgttagccaggatggtctcaatctcctgacttcgtgatccgccagcctcggcctcccaaagtgctgggattacaggcgtgagccaccgcgcctggcctaaaattttttaataatgagtttctatttctaaaacatcagagataattaatattcaacattatcttgtctttttctttgacagtgtttctccattaaattatgaatgatgataataattaatcacgctaaagggccaggcatggtggcgcacacctgtaatgccagcactttggaaggccaaggtgggaggatcacttgaggccagaaattcgagaccagcctgggcaacatagcaagaccccatctctacaaaaattttttttaaataattgggtgtgggccaggcatggtggctcatgcctgtaatcccagcactttgggaggccgaggcaggcagatcacttgaggtcaggagtttgcgaccagctgggccaacatggtgaaaccccatccctactaaaaatacaaaagttagctgggtgtggtggtacacaactataatcccagctacttgggaggctgaggcaggagaattgcttgaacctgggagacagagattgtagtgagcagagatcacgccactgcactccagcctgtgtggcagagtgagactccgtctcaaaaaaaaaaaaaatagttggatgtggtggtgtgtgcccgtaatcttagctactcaggaggctggggcaggaggatcacttgagccgagttcaaggttacagtgagctgtgattgtgcccctgcactgcaacctgggtgacagagcaagactctcctctgaataataataataatgctaaagacatcacatattgatcttttaccacacactaagcattatgccaagtacttcacatatttgatttaatttcattctattaagttagtgataactgtgttaataaactaaaaagtagtagtaagtattgagtactcactatgtgtcgggcaccatgtttcatacactttattgaatttaatcccaccaacagtcttgtgaagtagatactgttatcacttccactttgcagatgaacacacaggtaaaattatttgcgtgcactcacaggtaaagtcaggatttgaaccccgggggatgtgactccatagcccatgccgcaagcactaggctgtattataagcatcaattactatttctttccctttgagcactcgaaaggggcactgggaagtggtccagccacgccctccaggcagtgctgagcaagcctggccctcccgcttgccttctctgaccttgggcggcaggaaagcctggagctgcctgcagattcccaaggtggcctctagatggcacggttgagcattctttatttctgccggtggcatggccaaggctggggacagagccggtgaggcagaggaacaaaggaccagagtagaagcaataataagaagcccatggggtgatccctcttctccaggtcctcttgtggaagggcaggcagtgaaaacagtttctgtttcttggggcttcgctatgtgcttgggactgtaccaagcactctatatccattaggtcatttgctcccgctaaaattttatgaggtcgttgccgtggctcatgcttgtaattccagcactttgggaggctgaggtgggagaattgcttgagcccaggtgtctgagaccagcctgggcaacatagagaaaccctgtctctacaaaacatacaaagattagccaggtgtcgaggtgcacacctgtagtcccagctactcaggaggctgaggcaggaggatcagttgagcccaggaggtcggggctgcagtcagcagtgttcatgccactgtacgccagcttgggcaacagagcaagaccgtgtttccaaagaaaaaaacaaacaaacgtgcaaaaaccttctgaggtaggctctattttatgattatggatggagaatcagagcctcagaatgtcactccgtttgcaagaggtggagcttggacttgacttgaggatggactcctcttgagtgcttgctcttatccacgctgctcttccttctgcctaaatgccctggggagaagggggagccccaaaatacacatcagactcatagcctgacaaattgtctttacttccctctctattaatagaagtttaccgtccccaaaggcagacttggcgtgacgaggataggagacttgtccctgcaggatatgaggaaggtaccttctctggccctcatagagctgaccgcgctctgtgacatcctcggcttggacctgaagaggagcaaggcggggaagtggaaagcggcaggtgagcagccccagcccagggaaagccctgtggccacagtcctcatagggagctgaacacggactctcccagcaagagatgctcagctttgtctttctttcttttttttttttttgagacggagtctcgctctgtcaccaggctggagtgcagtgatgtgatctcggctcactgcaacctccgcctcccgggttcaagcaattcttttgcctcagccacccgagtagctgagactacaggtgcgcaccaccatgcccagctaatttttgtatttttagtacagacggggtttcaccatgttggccaggatggtcttggtctcttgacctcgtgatctgcctgcctcagcctcccaaagtgctgggattacaggtgtgagccaccacgcctggccagcatgctcagcttctatattccttctgtttacatttttttttctgcatatgtaaacaattcctgctcattgtgggaaatttgtgaaatagagtaaaatacaaaaaggaaaaaatataattcagaaaagcacttttagtgtattatcttcctttgtgtgtatatgtgtgtatccttttttcacctaatattatataattatggtttgggagcagtggctcacacctgtaatgccaacaatttgggaggccgaggtgggaggctcacttgagcctgggagtttgagaccagcatgggtgacatagtgagaccctgtctctacaaaaaataaaaaagtagccaggcgtgctggtgcacacctctagtcccacctacctgggaggctgaagtgggaggatcacttgagcccgggaggtgaaggctgcagtgagccttgatcatgccactgcactccagcctgggtgacagagacagactctgtctcattctatatatatagaactatgagaccctgtttcataattccattatatataatagaatatattatagttatagatctatattatagaacattatatataatagaattatggacattttccagttattgtatcatttagtggttgtcatgataatgctacataacaaacaacccccaaactcatgacttaagaattctttactcttgctcacatgtttatgagtaaactgggcgtagcttggctgatctaggcttagctccaagttgttggctgagtgtaggtctgctcacaggtctctcatcctcctgggaccagctggctgtctggaggatgttcttatggtgacagcagaagctcagagggcaaactgtaccgcattttaagcctctgcttgcatcttgtaggttaccatgccattggtccaaactagtcacatggcctagcaaggggtgaggaagtacgctgtgcttccctaatgggaagatttgcaaattcacatggcagagggtgtggatacaaagaggggtaatgaatttagaacaatagtgacatttaccacaactattaaatattccttgaaaacatgatttttatttatttatttttttttttttttgagagaaagtctctctctcttgcccaggctggagtgcagtggcatgatcacagctcactgcagcctcaatctccccaggctcaggtgaccctctcacctcagccgcctgagtagcttggactgcaggtatgtgccatcatgccctgctaatttttgtattttttgtagagatgcagtatttttatgttgcccagaccggtctcgaactcctgggctcaaatgatcttcccacctcagcctcccaaagtgctggggttacaggcatgagtcaccttgcctggtgaaaacatgatttttaatcactgcactattttcctcctcgtggatgtattctaatatatttaaccatttccctattagtggacatttttgatgcccatgtctttcctattataagacacaatcattactgctgtatatatgcttttgaatgcatcttagcttactttagattatacttatgagttaagttcctgagataatattgcccttcagcagtgtatgaaagtgttcatttcactgcagcattgtcaacattatgcattgtgattttttggtttgttttggtttggttttttggtttgtttctttaaagacaagaggatggtgaataaaaaaagaccagggggaggaatctagcagaggtggggtaggccagagaagggagaaagaaggaaggtgtggagaaaatgtggaaggaggagtttgcctgagaagacctcaagccagggtggttaagattgacccagggaatacattctctaggacctggcccatcctgcagagccagagctctatccaggactgctgttacatttttatacctggtgccttctggagcagcagcgtgcttccctttcaatacttttttttttttttctgtgagacagaactttgctcttgtcacccaggctggagtgccatggtgcaatcttggctcactgcaacctctgcctcctggattcaagcgattctcctgcctcagcctcccgagtagctggggttacagacacccgctaccacactcagctaattttttgtgtgtttttagtagagacagggtttcgccatgttggccaggctagtctcgacctcctgacctcaggtgatccgcctgtctcagcctcccaaagtgctgggattacaggcttgagccactgcacccggccctttcaatacttctttaaccagctaagattttctgctctgagacatatctcctcagcagtaatgttttaatgaaaacattactgctgaggcctaatgttctgctcaagaggagcggtttgggtccaaccattctctagagagctcagtccttccacaggaaaaggggtctgattctagttgcccaggagatcctgtaggtcggagcccagtgatcattccaagaagtgaaatgtgcctctgctctttgactttctgcagaaactcgcctctttggtgtgccccttgacagcctgctagaagctgaccacaaagtcctccccagcacacaggtcccgctggtccttcaagccgtaagtcgcccctaccccagcttgggtttatttaatccttcagaggctggctcaggggaccattgtcaggagacatccagcaaaggggtgaaaggatgtgctttagaatcaggcagacttgggttcaaattctggctctggcacttgctggctcagagacctggggtggatttttgctgttgttgttgttgttgatgttgttgtttttattttataaatttttgtcttggctgggcgccgtggctcacacctgtaatcccagcactttgggaggccgaagcgggtggatcatgaggtcaggatatcaagaccatcctggttaacacggtgaaaccccatctctactaaaaatacaaaaaaaaaaaattagccgggtgtagtggcgggcacctgtagtcccagctacttgggaggctgaggcaggagaacggtgtgaacccaggaggcggagcttgcagtgagccgagatcgcgccactgcaccccagcatgggcaacagagagagactctctcaaaaaatacataagtaaataaataaataagtaaatttttgtcttaattttttttgtagagacagggtctcactatgttgcccaagctggtctcgaactcctggcctcaagtgatccttggggtggattttcttttcttttctttttaacttctgaatcttaaagtcaagggtagatttttgaactttcattagcctccctttcaacatctgtaaattgggatgatgataacagtatcctcctcttatcaatgattaaatgagaaaaatgtgtatgaagctctcagaatgctgggctcatggaagtggtcacaaaaactaatattattccgaaggaaacccttctcctggtactcccctctttctgattttcatgggagacaaacacaccattttgaatcctgcttttcagcggttcctggtttaaatgctggtttctctttctgacagctgctgtcctgtttggaaaagagaggactggacatggaaggcattctcagggtgcccggatcccaggccagggtcaaggtaatggtttggcttcctggcttcactgaggctgcatctcccccatgctcacatgtgtgttaagccgggagggaaaccagtccctgactcgccagtgatctgtctttggtctctgtgtgggtcgagggtttgagaggctgaaggtggcatgatgagcatggtggcagagagtgtgggccctggagtcaggccaccaacgtttaatgagcagagctctgtgctcagtgacacgcacgttagaccatttcgtccttacttcaaccccacgagggaggtgctcttgttgtccccactttgcagatgaggaaaccaagccccagagaagtggtagagcgacttctaccagagccctgggccaactgtgttttcatgccccgccttcctgtaggggctggaacagaaactggagagagacttctatgctggcctttttagctgggacgaggttcatcacaatgacgcctctgatttgctcaaaaggttcatccggaagctgccgacacctttgctcacggctgagtacctcccggccttcgccgtggtgcctagtgagtgtgcccaagcccttagcctgtgcagggatggagagttggctcactggccttggtggagaggggaagccatgcaaaggcaggactccgtgttcctggaaatgtctgttccagaaatgtccaactgatgggggaagaagcaagtgtgaacatgtgagcccaatgtgtgcacatacacatgtgcacgcgtgtcctgcgtgtgttgtatggcatgtgtgcaggtgtgtgaggagaggaggctaaggttttgcacactacagtccctattagttctcacatggatgagtggactagtttccttcacatcttgacatccatggggttgagcttatcagcatcattacctgtgtatctgtgggcacacatgtgtgtgcatgtccatctgtgtgcacatctgcagatcagcatgtgttgcacggaccttgctgtatgtatagtctgcatatatatgttcctgtctggacttcttcacaatccacaatgaacaaagatagtcacttctatttttctcaaaaaaatacagcagctctcctgagatctcactcacaaccgtgaggttctccctgtctctctgaattctccaaaaagctccaaggctcaggcagtctgatttctacccccaagctagggacagggatcctgagaggtcctctctgacctttgattctcacgaccgcagcgttttggttgttgttgttgttcttcttcttcttcctcctcttcttcctcttcttcctcttctttcttcttctttcttcttcctcttctttcttctttcttcttctttcttcttttcttcttttcttctttcttctttcttctttctttctttttttttttttttagagatggggtcttgctctgtcacccaggctggagtgcagtggcatgatcctagctcactgcagccttgaactcttgggttcaagtgattctcctgcctcagcctcccaagtagctaagaatataggcacatgagaccacgcctggcatacttgtttaacatttttttgtagtgacgggggtctcgctatgtcgcccaggctagtgtcaaactcctggcctcaagcgatcctcccactttggcctcccaaagtgatgaggttacaggcatgaaccatcaggcttggcctcaacctcattgcaaaacataaatcagattccttccctatgctgttgcccaccctccacagcactcttgtaataagattccacttcttactaggcccacctcctccggctcaggtcctgcctatttctggccccctttcctcctgggcccctccttccccactgtctggccaggctctctcgctttgctgttccccctcctctttccttccctggggcctctgcacttgctgctgtgtctgaatggaacctccctccaccctcatttggctgctttctgccattcaagttccagctggctgtcattgcctgcgaggggccttccgtgaccccacacatcatgctgcctgccagcctctataatgatgcaatgatgcccatcatactctgatttattctttgcttgtgtattatgtctcctctctgaaatgtaagctccatgagcctgtgactttgttttcctcctttactattgtgtccaagattcctagactgagcacagcacctgacaggtacttgatagatatttgttgataagtgagagaaggaaagaagggaaggagggagggagggagggaggaaggaaggaaggtaggtaggtaggtcatatggggtcgcaggcctggcgcccagggtgctcagcctctgtctcctacgcagctcttctccaggttccagccagctctcagctgctgggtcttgtctggctctgatgaactccttctttgaatctataactactacctcctcctacctacctcctctccccggagatcctgacaccaggtgtgagacagcttttccttttcaaccctcacaacacagagggtttcatgaaaaccttctatctgggcccattgagctctctgtctcccttcctaagggtgatttgctggttcattgcatttctgaccctgggctgcagcctggactgcatctaggtctgtgcggcatgtgcttgcctgcacatgcatgcgtgtgtttattttgttacacaaagtatagcgagtgaacctcccacgagcactggtcagggctctgtctgagccaacattagacaaggaaatagtcccacaccttatgaaaaaagggattcctggctgtcccctggctttccagctctggaatttccccaagaagagaccagactgagggagggagtccctgagcctcccatggagactgaggtccctcccttcccgcagacatccccaacctgaagcagcgcctgcaggttcttcacctgctcatcctcatcctcccagaacccaacagaaatgccttaaaggtaagagttaccatgcaccaccaccactctgccatctcagcccacagccacagccatggcttcaaatgtgctcattcattcattcattcattcaacaactctgccaggtgctagggttcagtgatgacccacacaaacctctcttgagactttttcttaaagaaagtagatgagtcctgaaaggggatagtcccggagtgggcactgcagagcgtcagttccacgtggtgctaacaggtgttagcaccttgtggccaagcatggatgggtaaacacagagttcatgaaacaaggttaagaatacttttctccccaggacttctcaaagcctttggtatattgaggctttagagaatctccaagtgggattagagtatgcagcactctccaaactcagttgatcacagacctcttttgttgtggaaagcattgcatggcactggtgttccatgcagaaccagtttgggaaacagacccttagcaaattctccttgtcgtatgggaatggatgcagggccttggcccagctccctgtaccgtcttgactgtccttcagtcagactcaagatgtgcctccaggatcagcctgaggaggccccgggtcttcctgtttgagtttctgcttccttttcagtaaactgaggatgataatagcattaatagcatcttgtctaattgttttggaaatcataaaagctaactcatgaggaatcatggggtagaagatgatgctttgcagggtactcaatatgtgtcctcttttcctatcctctctccctccctctctcccttcctttcttcctccctccctccctccttccctcccacctcccttccatttattcttccttccaccacccatttattctcattcgtccatctattaatcttttctttctccattcatccatccatccatccttccatccatccatccctccctcccttcttcactccgtccctttgtccttactggctatatgactcttggcacattctccaagcttgtttccttatctgtaaaacacatgcaataataagagctaccttggccaggcacagtggctcattcctgtaatccctgcactttgggaggccaagacgggaggatcacttgaagtcaggagttcgagatcagcctggccaatatggtgaaaccccgtctgtactacaaataaaaaaattagctgggtgtgatggtgcacacttgtaatcccagctacttgggaggctgaggtgggagggtcacttgaacctgggaggcagaggttgcagtgagctgagccaagatcacaccactgcattccagcctgggagacagagtgagactctgactcaaaaaaaaaaaaacaaaaaacaaacaaaaaaaacctaccttataaagtttctgtgaggattaaatgagatgtaccaattaaaggcccaggaacacaaagaatacatagtaagtggtagctctcatcactttctgctgctcttctcagtgtctctgcttctcccagcatctctgcttctctattccttcctttgcattttgggtagacccagactccagaaagaaggagctatcctgggcctcaccaggaaatgacccatgttccagacctgtggcccttttctacctggaagttgaagtctgacccagttgtctcattagtctctgagggagcaggggagggaaagagtcttggacacactgcagagcaggaaacggagacacagagaggtcatggagtgggccggtgacacagctggaacgggagcccctcttgctgccctcccagctcctggctccttcctagcacccccttatcattcatcagaatgccctggggatggtggggaggcgccagggatgggctgagatttgagggaggctctgcacccttccctaggcactgctggaattcctcaggaaggtggtggcccgggaacagcacaacaagatgactctgaggaatgtttccaccgtgatggcccctaacctctttctgcaccaagggcggccccccaagctccccaaaggcaaggagaagcagctggcagaaggggcagccgaggtggtgcagataatggtgcactaccaggatctgctgtggacggtgagtgctgctgggcgctgggtatccctctgggtgcagctgccgtgccgcccctgctctccaggagcctgggcattgtcctttcagttccctagtgtgtcccttccaggacctttgttggcctctgcacaggcctgtgttttcttcctccccctgccttagtaaccaagaagaagtgtcttcactttctgtctccactgccatgcctctcagtcagtctgctgccatctggtctaccccagattgcaggagttcccccaactcctgcaaataattccttcacatcaaagcttttatgctgctgagaaagccccatccctgaggcccaggatcacagggcctgcctaagacagagcccagaaccagataacagggatacccctgccctcctgcccccaccgtgagctttgccctgagtaacaagtgacagcaaggggaggagccagagcaggagagaggcccctctgcggtgtcagcatgcatggtgcccctagcactgagacccctccagctcttgagactcctgtgaacacaaggcagcaccatctaccactgctgaccaggctgctttctcacctagcgatgcgtagcctcttccctccatctgttcattcatccttccattcagtctcccatccatccacccactcacccacctacccatccatccatccacccacccatccatttatgcaactgcccgtcacccacccactcacccacccacctatcccccccacccatctacttacccacccatcaatccattaattcctccaactcccccatccacccatatgccaatctatcatccactcacccatccaccaatcatgcatctctccactcatctaccaatccatccatccacccactcattcacccatccactcaaccatgcatctatccaactaaaccacacatctatccaactatctacccatccatccatccactcatctaccaaaccatgcatctatcccactatctacccatccatccacccacagtccttccctctatcccttccttcttccatggtcattaggttagatttcctattccagaaaccagcaagtgaagccctctctgactgttcccacttttcttcctaccctgcctgggcactcgtctgtgttctaaacacagcaaacgccagctggcactccaaactcatctagtacttcacacttctgaatttttgcttatgcagtttactctgcctggaattcccttcccttttttttttttctaagggcagaagcctggtgtcctctgctcattcttcaagacctcctagttcaaaagtcaactcctctgtcgaaagtcccctactcctccctcatacaccccttatacccccatagttcctttcttctctgcactcagccctttgagataatgttgctactgaaagacattggattgtaatacttctttttattggaggatgctttaaaaattcaagaaattcttgaatgttttcttgttagaaaagcttcagaaaacatagatgtagaaaaagtgaaaggggagaacccccatcaccctcgctcttccccgtgtgtgtcacctttagacagcacacacatagcagcaaaaaggggaattcagaatcgactccagtttcgtcagaccctgggagacagaaacatgttattagcagggtccatggagtctgggttctctgactctgctgggttcggatcccacagagaggcatgggttgatctggaggtctctgtaggaatcccccagtgtgggctctctgggggttctcagagcagagcctgctccaggtgtgttttggggacacccctgcctgagtgtgccagtgagcagctatccctcagcaggtgcaggaccctccagcttctgtcgaggggaccactatccactaagcctcagggtgggctccactctcagggtcccctactccaaggtccactttaggggctgaatgccccctcctcattccaccaaaccagtgcttccgtcccgtgtccaacaaatgcatatttccaagccctgtgggacgctgggccagggaagaggccacgatgaccctggagagggctctgcctctcgcccccagaagtcctatccccctgccaaaacttgatcctttctggccaggtcgcctctttcctggtcgcccaggtgcgaaaactgaacgacagtagcagcaggcgcccccagctctgcgacgcaggcctcaagacttggctgcggaggatgcacgcagacagggacaaggcgggggacggcctcgaggcggtgagtgcccccgaccccagacaggtggagaagggccgaggcgacaggagggcacctggggcgcggtgcttcccttcctccaggtccccgctaccgggctgccagcaacggcccagtgaggccaccagggggcgttgcggcgccgtcacggggagcgaggaggcgtggctgcgaaacgagggcttagaagcgggttggggaggggaaatggagtgactcggagacttcccctagaaaccgtcaccgccgccccatttttcggcagcccctggccgagggttgggaaaatgggagtcgctctgcggggtgtgaggtgattggggctgggtgggggatagtagaagggaagagccttccaaaaatactgagtattcctaggaggggtcctgaacacggttccttattaaagtcccgattagagaaattgatgagcgttgaggctgcaccgtgcacgatgtgtgggtgatgggtctttatacaaacctacatgtctgtgtttgtgggtgcgttgcatgtactcctgctgtgtgtacaagtgcaccgacacaggcatagaaacacaaacataggcatagaaacacaaacacacatctggaatgtgtatgtctgtgatctgtgcccaagtgtccggtatgcgtgtgtgtgtatcttgtgattttcagcgtgggcatttgcgtaagtgccatgtatgcgtgtttatgcatccacgttggaactccaggcaagctgactcttatgtatatggatctttctctctctctctctgcagactcccaaggtggcaaagatccaggtggtctggcctatcaaggaccccttgaaggtgcctctcacccccagcaccaaagtggcccacgtcctgaggcagttcacagagcacctcagccctggttccaagggtcaagaagacagtgaggacatggacagcctccttctacagtaagaggcacctcctggaggcaggagcctcttccctgcagggagggctctgcaccccagagctgaaggccaccagggggttacacatactgttggcctgacctggccttccctttctggggtggtcagatgggttctccaatcttagagagtttcttggctccaagtaataatcatgatgaccaccactcactcattcactttaataggtatttaatgaatgcctaccaccaggcaccatgtttttctgttggtttgtttgtttgtttgtttgtttgttttgagatggagtctagctctgtcacccaggctggagtgcagtggctcgatcttggctcactgcaacctccttctcccaggttcaagcgattttcctgcctcagtctcccaagtagctgggattacatgcacctgccaccatgcctggataatttttttgtattttgagtagagacagggttttactatgttagccaggctggtgtcaaactcctgacctcaagtgatctgcccacctcagcctctcaaagcgctgggattacaggcgtgagccaccgcacctggcccaccatgtattaagagaattatagactagccatgaaaagaacagacagaggccctgctcttaagagctcacagtcctgaggaagacctggatataaagcagatagtcacgaatcaaagatcaagttacaaactgtattaggtttcataagaaatgcagggaacaatgtgtctggaagccaaggaagctggtgtcatctgggagcgaggtgaggcttccaggcacagaaaactgcacagtaaaggtcctgcagcaaggagcagagcctggccaaggatctggaagaaggtcgggggctgatgtgcagccatcattcctagggtacaggaaacagcctgagacctcaagagcttccttgttggcattggcacaagggaccctcagactgtcatcttcagcaagtatctgatccagctcctccttgaacagatgggagcactaagactcagaaaagagaagggacttgccttaggccacatggcagaaaagaggccatggaattgaactcaggatacccataattatcatataataattgtgattcttacatgataggcatcattatcatatgtaatcatacaatgtccataatccatcttgactcaaaatcttcccctcacagcaggctcctgtccccatctgtcaccactcattcccttgccttcgcagtctccattctgatgcccagaagaaaggggcctcgcagcggggtgcacccctggctgagcctcaccacgtgccctccagctacctctccccagcccctgggtgctggactctgtcactggctccagctctctcaggagggtccttatgctgcttctccccagcaggaccaaaaatcagtgaggactgccctttccagggctgggggccatgcacagttgttggtcttgatgtttccagaagaaaaaggcagtagttttttttttctctctctctgttttacagccataggtccatggagtcagccaacatcctcctctatgaagttggagggaatatcagtaagttccactgtgggaaacaggaacagagcccgggtccctgggagttcttcgacctcaaaggctcactgggcccttctgtgggaggccagagtaggcctgcagatgagccctcccttcaggtctctgtcttcaatgaaaccaggtggagtcctgctgtaaggttaaaggttagcctgtgcaagtcttaggagcctatcctggagtttggattttgcctagagctggcctcaggcttgcagagagatgcagaagatttgtttagtgtgaaggttcacagtagcaccagtgaaaccgacgcctctgggacaccctagctgggatggacttcatccctggcctaggggccaaggagtccttaaggaattctgcaaacacatatccagctctgggagttccctggctctgtgggaaccaaggatgggccgctgtttccctttgcattctctagagtaatgatcctcagactttaccagaacctcaggatcccctggagggctaagacacagattgcggggcctaagaatgtgtgtttctgatgagttcccaggagttgcagatgctgctggtcggggggccacactttgagggccactggccaagaagcagaagctaagacatgtcttcagtagtacacgatgcattgagggggtgcccctcaggaaaagggttccaagggacagagtgaaggaggatagggaaggggcaggggccaggagtgttcgcatcctggagcttggcctgatccactaggtggctctagagaacaaatcacatcagagttgttgcattctgaggcaagggcactggtcttcagtacatctgtgtccgtcagtcatcgaccgtgggcttcccaggggaaagggggtgtcacttttctggcaaggcatcttccctcagcggagctcagttctccagcaaaagaagtagctgtgagctgtagcagtcaagatgcatacagccaggggacagtgcactgcctggtgaagggctctgtgcaggggaacagcatctcctacagcctcccactcaacctccttcaccccttcttcccacagatgagcatcgcctggacccagatgcctacctcttagatctgtaccgtgccaacccgcatggtgagtgggtccttaaacagaaccccacctaaaccctgcgagtctcaggagcagcctggatgcctcctcctctcccctgctggctctgtgtccatgtacccagcatgagaacaaagctattccaggggagggtctgagttttattccaaggcttccttttctgaaatgcctctcagacccctcagaaatagactcaggggtggtgctctctccactcagaggggatgaggggctagggcctcagggaggggaggccaacactgtagccatgatcagccctggaagaactggacagaggaagaacttcccttcacagctctcatgttttaaccgtgcacacaatgccctcactcccctccaccctccagccctccagagagttgcttcctacaccaagcttgctgtatgacgccaccacttggggcgcttggatctccatgggcttctgtctgtggcttccagactggaggaaaattaaaaatgcagtacctttatcaagaggtagttggggtcttttccccccaggcaaaattgtttcgaaagtggccctacaatgtgtagtagcagcagcaccagagacaaaaccaggagagctctgtgaccttggacaagccccttgccctctcagaatcctttcaggatgaggggctagggcctcagggagaggaagccaagattgtagccatgaccagccccgggagaaatggacagaggaagactttgcttcacagctctcatgctttacatgttgatttgtacaatcttgtcattttgtaatatgatataatatgtaaacgtaattgtttaaacagtaaaggcacaacaagttcaatgtcacatttactttgcctgtttttctctccagtccagtgctcggtaggtgttgtccttccagcgagttgacgtgggagcttggtgacgagagcatcttgctgagctgctcaaagggctctggcccatgtgatccagccacgccttgaacccacaaccaccgggggcgggagggcaggaagagaactcagaatggggaggcatggagtaatgatacccattgctgaagggtgggggcattgcagggacagcctctctgggaatcctctcatctcctacagtcccaggtctcacccttcctcttctcctctgccctgggtctgtatcctcaggccaggtgaggcttcgcttatttgttcacttaacaatgagtttactgagcatttaattatgtgccaagaggttcacaaatttaatcttcacaataatccagtgttttcggtttgggttcccccagaagcaaaatgtgaggcaaagactcaaatgcaaatagtggtcctaagaaatgcaagagagtggggatatgagagaaagagggggaggcagtctataaaagggtgcccaatcacaagcaagctaccactgggggcatctcgagcttaattccactggagaactctgagaaacagtatggaagatgtccttcagagttaccctacccaagggtcaagggagccagtgtgtttattcaactcctgtgagtcattggttgacagctgctcctgaggagtataggtatttgtttcctggtacttccgcctgccagagtgcaggcacagtgtgctccaatactcagagaaagccctcaagaagagatacagatactggcaagtagacattggccactgtacacagatggcaagtgctgaagggatatgggtgggcatcaacagaacctgcttcatcctgtgaggcaatgatggtgagatactgatgctgatggtgatggtgatgctgctgatggtggtgatggtgatgctgctgctgatgatgatggtggggataatgatggtgatgctgccgatggtgatggtggtgatgatgatggtgatgctgctgatggtgttgatggcgatgctgctgatggtgatgatggtggtgattacgatggtgatgctgctgctgctgctggtggtgatcctgctgatggttttgatggttatgatgatggtgatgctgctgacggtgatgatggtgatgatgatgatggtaatgatgatgatggtgagggtaataatggtaatgatggtgatggcgatgatggtgataataacgatgatgctgatggtgatgataatgatggtgatgctactgctgttgccactgatgatggtgatgatgccaagagcttgacaagtttgatcttcacaataatccagtatcttagtttgggcaatgatggtgatgatggcagctgtcactaagcagttactacgcaccaggcattttacagatattaattcctttgattctcacaacaaccctatgtgacacgttattattccctttttataggagaggaaaaaccaaggctcagaaagttaacattacttgtctgcatggctgataagtgacaggttaatctggtgtcaagatgcaagctctactattttagaccataaatatgaactgttttgccataaatacccatatttaaaagtgttttggtaatggtcacttcctcaatgtcccctcttccctccctcatcccacaatacaaataatctcagaatgagagaaggtatttctcttaaaccaaggagacctagtaaggagggattgacatttgtcctggaattcctcaatagagcatttgaagcttgtagctggttaagagcctctgagcggcctcagtttccctagcagccccatctgaagagccaagatgtgatgaagcatgaatttagcctagcattagccccacaatcctatgaggtgagtgttaccatagttccactttacagatgaagaaactgagtttcagacaagttaaaccatggattcaaagtcacacgcagggtgagaaacttggatgcctgattccaaatccagggctttttcagtcacaccatgatttcctgaagcaatatcaagtgcctgataggtgacagcaagaagagtcaagaacagcagtaggaaaattggacaaattatttaagttggggagataccaagggattcagccagagttgctacttctgttcaccaatgtcctctctacctcccatggtctacctacaagccttttggacctccctccaaaatatactccaatccatccacttcactcctttgttcctactaccatcctaatccaaactactaccatctcgatgccttggataatagtgatcatgatggtggtggtggtagtggcgttgatgatggtgatggtaatggtgatgatggtggtggtggtgatggaaatgatgatgttagttgtggtgttgatgatggtaatgataatgattgtgatggtggtgttggtggtgctggtgatgataatgatggtggtggtggtggtggtgatgatggtggtggtggtgatggaaatgatgatgatgttagttgtggtgttgatgatggtaatgataatgattgtgatgatggtggtggtggtggtgatgatggtgatgatgattatgatggtggtgttggtggtgctgctgatgataatcatggtggcagtggtggtgatgatggtggcggtggtggtggtgatgatggtggtggtggtggtgactgatgagaatgatgataatctaaaatagttaagagtttacatcttgacaccagatggtgcaaggccttgatggcctccatgcctcttaactgctctcccttcttgctttcctctctattcatatatagcagctactgtgggcctttaaaaatataaattcaatcttactgaaagccctcctgctgaaaactttccagagggatcccattaaacaaatatcccaactctttaccctggcctatgaagccctatgtctgtgacaccacttcactcatactccctcccaccttactttgcagagccagtcagtcacatgagcctccttccaactcctcagacatcccaagttcattcctgctttgggcttttgcacctgctgttctctctgtccacaacactcttcccccagctacttccatggccagctcctttcgcctttggatctcaggtcagatgtcccttcctttgagaggccatctctgactaccctatctgaagttgcttcttctgtcactctctctggaattgccttggtgaattttcttcctagcatttattactatcctaaattatcttattgagtcagttttttattttctgtctccctgactaggatgtagccccatgaaggcagagactatgtgggcttttctcacttctatggatatgatggatatgatgtggatataatggtactagcagatgctcaataaaaattggctggatgaatgaatgaatgaatgaatgaatggatggatgaatccctctctgtccctttgtttgctctggaagctgttgcccttatcaccttatttaactctcacttccctgggttcatgtatgaaaatgagaaaatgcatctgaagtacttatagcaagtgctcagccagtgctctcattattattattaattattaacaaaggccagacagcctaaaatagtgactaatggtactatcctcttgtgcttcccagcacctgcggtggtccctttgcacacctcattcactcattcccagggtctggatgacaggatgcagtgtggttggagggaaaatcctttacccttggcaggaggtgaggcaggttcctctgtgagtgctgagagcccaggccctgctgtgctaactttgcactcagagtgggctgtcagccaccagcagagggtcccagtttaatcacatgtcagtttctccattcatcttcggtgctatctgagggctcatctttttctactctgtggcatcgtcatgattgatgatcctgcaccagctccaccgccgggttagctatattagcatagctcacagtgggtgcccagctcctccgggctctttgtggtctgggccagcatagggtggcatcatgtttctcttaaggagctctgttgtgaatggaatcgtgtcctcccaaaattcatatgttgaatccctaattctcaaggtgactgtgtttggtgataaggcctttaatgaagtaatgaaggtaaaatgaggtcctaagggtagcaccctcatccaatagggctggtgtcttcacaggaagaggaagagacaccagagccccctctctctccccacgagagcagagaggacaggcggcgcgaggacgcagtgaggtggcaactgtctgcgagctaggagaagcctcaccaaaacccacattttctggtaccttgatcttgggtttcctacctccagaaccgtgagaaaatagacttctgttgtttaagccaccctgtggtgtttgttataggagtcttagtaagctaatagaagctcctagctgcctccatcttctgagaggaaggaggatggaatttgtaaagatgtcttcaaccaggagagtttccttggacaaagggtggaaatgagcctcagcaggggcggactctcacctggccctcaggtgtgtgctttcctgggagaggctgcatttattgctatggggctgcaggtaatttgcccaaaccaaaatttgcaggtaatttgcaaactgaatctctatgctcctagagattcagtttgctctttctagatcaccaaagaggatgatgaggatgaaatgaggaaacctacagtcacgcaacaattatatcaagcacctactgtgtgcctggcactgggctaggctggggccacagtgatgagcaaatcaaggaaggtcccagcccttgtggagctcacagtctagcgagcgagagatatactaacctagaaatgaaaagattttatattgtaatacaattctgctgagaaaagtaaaacagagacgagagaggacgtggggaatgtgggcgaatctttgctttgaggggccagggaagggtcttagattgagtgccctcagaatcagaccctgaacgaggaaccagagggcagggtgcttatttgggaggtgatcccagaaagacgcagtggaggaatggggaagtgaggcggggaggggagaagccagtgaaggtgtgctaaagagcaggttacggcttcgggcaactgggactccacgctgcaggggttcccgggaagccgcgtagaatacgccgctgacacgtggagtaaagaagggagagtgttaaccaccaacccccaccacttactggtggaggactactcccagggcgtttgccccccggcatttctacctggtcccccaggcaggctcagcaccctcctctgccagaggaggatctaggcagagtcctaggttctggcaatagaaagccatcagcatggacaggagccatgggtgctggggtggggcagatgtgacctgtctgaggaggcgacccttgaaccgacaccaaaatgatgagaaggggccagccacgggatgagctgggagaggagctctgcagataaaaggaagagaaagatctcggccaaagcccttgtcgacgctttcgttgtgtgcaggtcagagggattgttgggacagcctgggctaagggatgaatcaggttccccaggagctgaatcaggttccccaggagctctctctagtctctctctctctttctttctttctctctctttctttctctttctttctttctttctttctttctttctttctttctttctttctctttctttcttcttttctttctcctctctctctctctctctctctctctctctgtttccacccagacccctccctttgtacccatcttcaacggaggcagtgattggctggccagaactgtgggcggggcctttggggtccaatcctaggaggatctgggccattcattggcccctgtgggaggtgggcgaggtggagaaatgggacccccaaggagggaggtgagaagcaggacaagttgacaaattccgcaactacgaatgccctccacttccctagtgctggaggacagggctgagccctctggccattcattgatgctcccatgtcacactggtcatgcctcttggtggcccgaagtggcctgcccccaacaactgcaggtagccccaggacacagggagcaccagtctggcctagtgtcgcaaaggcctagtgccacaaagaccacagtgaggccaattggcacatgtggaccacacagaggggtgctctgcctgtagtggccaaggtagtagtggagcccaggccttggatgttccattaggaagtccctagagtgccctgcgggcatcccctggcttggcagcgtctcagtgtgggtccccagaagcaggcagtgagacaaggactccagtgaaagtcatttatgtgggaggcgaaggaaacagcagcaggggagtggagacatgagacaggcaagggaaggcgccaataagcagcgcatcatcaaaccagctaccgcatcacaccagctactgcatcacaccagctaccgcatcgcaccagctactgtgtgggtgactggagctgaatcccactggggaacccagggagaccatggagacacttctcagggttggttacccctgggaagcaaggaagcaggagtattgaaaagcccactctgggctgggcacggtggctcacacctataatcctagcactttgggagacagaggcaagaggatcgcttgagtcaaggagttcaagaccagccagggcaacaaagaagaccctgtctctacagtttaaaaacattaaaaattagctggatgtggtagtacatgcctgtggtccctgttactcaggaggctgaggtgggaggatcacttgagtccaggaggtcaaggtcgcagtggttgcagtgagccatgatcacatcactgtactccagcctgggtgacagagcgagatcctgtcaaaaaaaaaaaaaaaaaaaaaagcccccatcatggtcagttactgctcaaggctgctttgggtggtcatacccctgaacgtccagcctgtgtgtgttggagggaagactccatccgcgggacttgttggagcacactgaagtcacaagcttgagagatctggattgggtcgacagtatcacttcacttatttggaaattcaattaactagagttatgttctcagtaatttctacaaacccgtggggctaatgtagggtaccatgtcccttatctgacctttgattcctccacccttctcccagcccctagctccccaactcaagcatccctttgctccaaggcacagtgtctccaggagacaccttggaaggagattcactctcgccaaggttcctcatcactagcaggggccacccaaaagcccagccctaactcccatgaagcagagagagcccctcccagctattctgcctgcctccttgttccctctcccctcccctttttggccccagtgtcctctgaactcactctgtctgctcctgcatcacagcctctgcatacgttggccccttttcttagaatgcattcccaccactccagtttctgcctgttgaaaagtttcaacgtgcaatcaacaaaaatgtctattgagagttaggcactgggaatggaacattgactcaacaccacacagaacttccttttggagtttgcactcgggtggaaaaagaaatcagtcatcacacacatttttctatactcacaatacggtaaatgcaatgaagaaggacagggagacacaaacatatagggttggggggtggtggctggactggatctggggtttcccaggaggtttctggggcagtgatatcaagctgaggcttgaaaggtgagtgggtgagaggtggaagggagcatcccaggcagaaggaacaacatgttaggccctgagatggactctgcatagctggtgtggctggaattgagagaaggcaagcgggcagggggcagagtgggcaggggctgcaaatggatcctgagagatttaggaagacaggaaacatttacatctatcaagccgccctgcctgggaattctgagaatgccctaggcttaccctcagctcccctaaatgcagcccccaaatcctcctttaggagactgtgctgctaatctgttccagagacaggcttgggactcactgcccccggcacgccaaaggagtctcatacattcttcaaggcctaattcaagttgctcctctctgagaagctctctaagctgatttcagcttagagagcttctcccacctcccaagtcctccacctccgaagtcctccttagctcttggctctttggcatctgagagcactgggacaggggtgaatattccttagtctgccgcttggggcagggcagcccaggctcttgctccagggacggtggacgatgctgcctggtacctggctgtgggcaggtgtgggccaccacctccaaggacccatcattcctgcctgctcctcacacctggagatcacaggatatgtggaattgaagcttttagggatccataagggacttcatccacagacttgcagggaatgatggtgggctgggggagggggtcatccccttttcttggtttttccaaggctggggtggtagaaaggaaaatgattcctggcaaacccgtgctgctgtcccgtgcctgcctcccagggctgctgagagggtgggagatgccttctattgagaactccccacccccatccccaaccactttgcattctggggcaggggagtgggagccacttgtcattgttcctgtacgttggctggcaggaggcccagggagggggctccccaatagaaaatctgcagctgcctgtctttaaggtaaaattaccgtaattaccccaattactaaatccatcaagagctttggaccggaggcctggagaacaattgggccctgatggatctgaggagtatgagtcacgggggtgggggcacaaagcacatgggatgaaggcgagtgggggcggcagctgatgttaaaccaggggtggggatggggaaatgcaaagagattatgattagccaagaccccactttcctccttcagtgagatttttcttctctattggaaagaaaaaaaataccccaaattctgtctgccttttcctttcacagaaccctgcaccttgggtgggcgttgtgactcacgccagtaatcctggcactttgggaagccgagatggaaggatggcttgaggcctggagtttgagaccaccctgggcaacaaagggagaccccgcctctacaagaaatttaaaaatcagccggccatggtggtgcgtacctgtagtcccagctactccggaggctgaggtgagaggatcactagagcccaggagttcaaagctgcagtgagctatgatcacaccactgcactccagcctgggtgacagaacaggactctgtctctaaaaaaaacacaaaaacaaaagaaccctatactctatggccacctgacttagacccgctttgaccttttatgagagctaaaatgtaaagagttgagagcaatggctagcatctcctgggtcccagcatggaccaggaactatgggaagagcttttcaggcttcctccctttcaatcccatgaagtgggtttcctcctgcttcacagacgtgggtgcccacatttcctcttggcctgggttctgagcagaccagcccctgggcctggttggcttctgtattcctcaccatgcttggtaaaggaagtgaaggacaaggttggcagattaggtgggctactgggaaaagcaccttataggacatgtcccctcttttcatttctattagaactttactacattcaaagagtagttaaaacattcagattcttcctctcagttgatctggatttgtagcctaaggaaataatctctaattgtggaaaggctatatcgtgaagctaattctttcagcattgtttatgctggctgcacaatttcactttaagagaagatccaggctgctgatgcctctgtactccattgccaggaggagttatgtctgcaggaccccaggcatagaagaaagagatccccttggctgaagtagacttagaccagaattgggaggcagatctgggtttccacagaagtcattgggaccaaagcccccacaaattataaaatttaagtatgacctggcttgtccctggtgcctgtatctccaaggtgactttgcagggcttgtaggtgttgctccaagatttaggatgtcagggtccaggccaaatagcttcctaactcatcataactaatatggttaacatggaaaattgtgaaacaatttaatgtcaaaacataagggccagcgtggtggctcatgcctgtaatcctagcactttgggaggctagtagggagaatggcttgagctcaggagtttgagaccagcctgggcaacatagtaagacctcgtctcatccaaatatcaaaaagttagtctggcatggtggtgtgcactcaggaagtggaaggaggatcacttgaatccatgagtttgaggatacagtgaactataattgtgccactgcactccagcctgggtgacagaacgaaaccctacctcaaaaaagaaaagaaaagaaacgaaacgaaacatagggagactggctgaatagatgaagttttgtgcaggcttttaaaataatgagtaaaaagattcctttgaaatctgggaaattacaatagaatgtttattgtcatgctggttttttgttttttgttttttgttttttgagacagggtcttgctctgttgcccaggctggagtacagtggagcctagagaagggcaggagagcccttgaccatcacccaggctggcgccaatcctcaggggctgagccactccctctagaaggcctgggctcaggaaatgcccctgagtcagaaacactgtgggacaatattccctgacattttcccaaaaaagggccctaagggaagaggaaagtgcaggtgagcttggagcaaacatgaactctacccattggctcattcaattattcattcatccattcaaaacactattcttgctataatcctaaacaaattaacccaggaacggaagaccaaatacctcatgttctcacttataagtgggagctaagcgttgagcacacatgggcataaatatgggaacagtagacactgtggcctactatgggggagggggagggtgggttaaaaactacctattgggtactatgctcactaccagggtgacaggatccatactccaaacctcagcatcacataatactcccgtataacaaacctgcacatgtactccctgaatgtatctgaaataaaagttgaaggctggatgccgtggctcatgcctgtaatctcagcactttgggaggccaaggtgagaggattgcttgaacccaggagtttgagaccagcctgggcaacaggacaagaccctgtctctactaaaaataaaaaataaaaataaattagccaggcgtggcagcatgtgccagtagtcccagctgcttaggaagctgatgtgggaggatcacttgagcccaggaggttgaggctgcagtgagctatgatcgcgctactgcactccagcctgagctatagagcaagaccttgtctcaaaaattaattaattaattaattaaaatatgagttgacatttcatttaaaatcaaatgttctcatggtgtcctctgtctacagccctgtgatgggacctggggatactgccatgaatgagacagaactagctgccattccaagcttccaaggcagccacacaagttgctcttttgtgaaattttatgatttcctctcaaatattcacatgaattttacattttattttgtaatgtagccatgcttgtttttgtaattttaaaatgatgttttcacaacaatatgcatggacttaatgccactactggattgcacagtcaaaagggctaaaacagcaaatgttatgatatgtatatatgtgtgtgtgtgtatatatatatatatatatatatgtattttagacagagtttcgctcttgttgcccaagctggagtccaatggtgtgatctcggctcaccgcaacctgcacctcccaggttcaagcgattctcctgcctcagcctccaagtagctgggattacaggcgtgtgccaccacgcccagctaattttgtatttttagtagagacggaatttctccatgttggtcaggctggtctcgaactcccgacctcaggtgatctgtctgcctgggcctctcaaagtgctgggttacaggcatgagccaccgtgcccggctggtatgtatatttttattgtggtaaaatatacatacaaaaatcttacaattttaaccattttcgagtgcacaattcagtggcattaagtccattcacattgttgtgcaaccgtgaccacctccaaaactttttcctcttcccaaacagaaattctgtacccattaaacacgaattctgcatccctccctacacccaccccgggagccatcattgtactttctgtttctctatttttattttttatttttttgagacagggtcttgttctattgcccaagctggagtgcagtggtgcaatctcggctcactgcaacctccgcctcctgggttcaagcaattctcctgcctcagcctcccgagtagctggaattacaggtgtgtgccaccacatccagctaattttttgtatttttggctatcattcattcattccacaaatattggctggttatctgccatgtgccaggaactctactagatgatatgaagatgaacaaaactggacagaacccctgccttcatgcccttcctgcccacaggggaggcaggcattgatcatggcatctctgtcctgtggtactaaaggtccagcagcccatgctgggaggcagcatttcaatcagcagtggggattctgcttggtgggctggcccagatcccagtgtcccatcacttttctgagctcggttttctcatctgtgaaatgggagtgatcactctccccatccaaccttttggtgtggcaggatgaggttctctgttcctctcaccctcttctttcctccctcctctgtgagatcagcaaaggcaaattctcatccccattttgcagatgagtagactgaggatcagggaggcagggcagagtcttcaccagaatctttcccaggatggtccctgtccctcactaagtcactggatctgctctccccagcctgggggcactgccacccctccagctgggctcctaccgagtgccagtcaatgtatcctcgtgtctgagggcaaagactagaggcctggcaggactctcccagggtatctcctttttacctgtgtcctcccaccaggcagggttccctgggctccagcaggtgcaggcaggaaccccccagggcactttacttccccagccttcaaaagagttctctgcctatgttgttttctgtccagttggagcacaggtcccacagtcacacagaccaggtcttagttctttgctgatctgtgggaccttagctggggttctctaagtctcattgtcctcacctataaaaccactccctctggttgataaggaaactgtgctcacctggtgggacactgctgcattcaccaactcaggctgccataacaaaacaccatagcctgagtggcttatgcaacagaaatgcatttccttccagttgtggaggctggaagtccaaggtcaaagtgccggtagggctggtttctcctgagatctcttacctgggcttgcagatgtgtcttcacatggctttttctctgtgtgcctgcattcctggcatcctcctcctcttataaggacacccgtcctatgaaccagggcccagcccttatgatgttccttttacctaattacctccttaaaggtcctatctccaaatgcactcaccttgggggttagggcttcaacctacaaattctgagggattgaggaagacacaattcagtccataactactcagcaattaaaaggaacaagccactgatgagcaagagaagccagacacaaaacgtagacatgtatgattccatttatatgaaatgctggaaaagtcagaacgaatctacagtgacagaaagcacagctgtggttgcctggggctgcaggaggggagaattcttgggacaatccgtgggagaactgactccaaagggttccaagggggctttctggggttgatgaaaatgttgcctcttgattgtggtgatggttgcatggaaatatacatttgtcaaaactcattgaactggatgctgaaaatgagtgtgtaaattgtatgcatgtaaactataccttgctaaaataaaatttaaaaccctacctcaaagggttaaaaaaataagactcaagttaggtggttgttaggagtaaatgagttaatgcctgcaaagtgcttagcttggagcctggcatggtgtaagtgtgcaagtaaatggtaaccatggtaacctgaaaacaagacttttgcccagtaagtggggcaagaaagagaaataaacacagaaggcaaggggtggggagtgatgcttctcccatgcccagagcagacaggcaggggctgtgatctcagcctcctggagtcatcgggtcactctcccggcccaggcgaggattcctataatgcctgtcagcatcttttgggccctgggggcagccaactgcaacttagcccctgttcagccctgatcctgttttttttttttttttcattcattcactgaacatgcacattggaccacctagcacaacaaaagacaataatagctgcttctgtttactgaatgatcttatgtgctcagtgcttgacattttgggctgaaccaaatgaaagagccaagattccaccagtttttacccacaaaatgccagtttactgtggttcaacctgatacatgatctctttcattgttatgacaaatctgagagtagatatgattatttccattttgtggctgagaagatggaaattcacagaggtgaagtgcctggcccaaggtcacacagctgtgagtagctggatttgaacacaggtctgactctgaatcccgtatgttacatgttccttgcccttaaggagtaccggtctagtgtagggatgaacacattaaatacggcccccggggtctcgcccactcaccccctgaatccccccaacaggctgccctcagcttttcagacactggacatgagtgttcttggtcttccaatgatgccaaagtcctgccgccctgcaaacagctcctctgcccaccaggacatcttgccttctccggacctgcttctccccggacctcgggggttgtgtggtcagtgctggctggtccctggtgaagctgtacttatgtgtctctgttgccccaggagttgccctcattctgcccatcttgtcctcactccaagcccgccccttcttaaagactccctctgagttcaggttcgtctttaattcacagctcattagtagatcaaagaggacagagacaccctgagtctaagggaccctcaggcagccccatcctcacactgtaacaaggtgcccccttggcaggagacaaggggatctccctggctgctctttgtgaagcaaggagagggggctgggacctggctccaggctcccccatttataacagggccagaggttcagctggcagggctgaggcagaggcattggaaagccgtcagcccctcctccagagcctgagcaggacaaggacagttaattcctctggtgttatcagctgggcacaggctctggttgcatagcaacccggattgctctctgcctctagtgttccaaaaaaaaaaaaaaagcattttctccaactccatgaaatggaattgggcccagggcagcccaggctccctgcccccaagtgtggctcatttgtaggaagctccaacccatgccctgctgtgggatccccactcttaaggccttcatccccgtcttgcctcacccatgccaggctgggggtaggaattcacccaccaccctactgctgcaatgtgaagctgggtcagaagtgaagtctcagtttgtccaaggggatgctggacaggcctgggatctgggtgaaaaggcatgaactgggggagcccagccagttctggcaatgcagtttacttattcattcattaagaaatatttattgggcacctactgggtcccatacccgtaaactccccagatttggtgagttaaagatggctgccaactctttgccactccttccatgaagaagtggaatccaggccgggcgcgatggctcatacctgtaatcccagcactttgggaggccgaggcaggcggatcacgaggtcaggagatcaagaccatcctggctaacacagtgaaaccctgtctctactaaaaatacaaaaaattagccaggcgtggtggcgggcgcctgtagtcccagctacttgggaggctgaggcaggagaatggaatgaacccaggaggtggagcttgtagtgagccgagatagcgccactgcagtccggcctgggcgaaagagcgagactccatctcaaaaaaaaaaaaaaaagaaagaaaggaaaaagaagtggaatccatttcccttcctcttaaattggggctggctctgtggctggtctggccagtggaatgtgacagtagtgacaccgtataactctgagactgagccctaagaaattagcagattctacctttgcggcttgaaatgctccttcttggaacaccatcaccatgatgtgaagaagcccaagcagccacgtggagcggccctctttaagtctgtatcatttaccagttgcatgagtaaagccatataataccatgtgaagcagaagaatcctccagctgaaccctgaccaggtccttgacccacagaatcatgagcaaataaaactattctccctttaagctagtaagctttgaagtagcttgttatgaaataatagataaccaaaacaccaggagagcttagttttccattcatagattctcaaataccaacacatgtggtttaagtacctgatgtatgctagaccctgtgcccagttccaaagcaaaatgccactcacgctggggaactggaggcatcaggagacggcacagaggcagagagcagaaccaagagcccagagataagagcagacaattaaatagaaaccacctataattaaaggggtcacaaaataaggtggggaaggcaattttcattgctactcagaccacacagtgttgaattcaggtatcaactctgcatatttggaaataggtgcctgggccacatgggagggattctgaggtgaagtctgagctccggggtgatggattcatggtgtctacagtagttggggagaggagaatgcaggtacctgtctcatgcctgtgcttcttgagcccatgctgtccgctggcctctgtgactaactcttctgcacctacttagacaaggagagaggcgggaaaacaggttgttcaggcaggctttgtgggggctagagcagagaggaccccaggcatgcattcatacttttcaaactggagttatagacctccttataaaccagcagggcagcttcagagggttagtttttagtttagtttagttttgttttaaaatgtcttctagtcaatttagttcaaaattccatcatcttgttctgtattcctgggtcagactttcacctggctcttttttttttttttttttgagatagagttttgctcttgttgctcaggctggagggcaatggcgtggtctcagctcactgcaacctccgcctcctgggttcaagtgattctcctgcctcagcctaccaagtagctgggattacaggcactcgccatcacacccggctaatttttgtatttttagtagagatggggtttcaccatgttggccaggctggtcttgaacgcctgacctcaggtgatccgcccgcctcggcctcccaaagtgctgggattacaggcatgagccaccgtgcccggcctctttttaatactgatgtctgggctctacccacccacccgcttcatgcttgggagtcactattttacaactcctcagctgattctaacatgcagccagggttgagaaaatagcgcctaacccttggagacacacagctgataaaaggaaagtcttcgttctcaagaaacgtctaggtttggggtggggagtcgggggtaagtaggaggcagttgtgtgctgaaaacgtttctgtgttccagggaaaaaaggcttgatttttagcatttgctgatttttgtgatatagatactttcactatggccgatttcaagccaccaatgtgatgtaactgaaagctgggttgggatgagaggcacaatggcacaccacatactagaggcaggcacatccacagctcatgacaacgctgggtgagaagggctgcagttactttgcactggaccagcatcagaccagcagccttggcaccacatgggtgctggtgagagaggcagaagctaaggttcaccccaaatcaactgtatcagcatttgtgctttaaccagatctccaggcgattcatgagcacatccaagtttgagaaactctgctccaataaatggatctgtaaaaaccttttctggggcctgacatggcatggtggctcatgtctgtaattccagcactctgggaggccaaggtgggaggatcacatgaggccaagagttgaagaccagcctgggcaacaacatactgagacacctgtatctacaataaaataaaataaaattagctgggcatggtggtgagtgcctgtagtcccagctactcaggaggctaaggtgggaggatcccttgagcccaggagtttgcggctgtgacgatcaatgattgtggcagtgtacctcagtgtgggcaacagagtgagaccctgtagaaagaaagaaaagaaagaaagagagagagagagagagaaagggagggaagggaaggatgggaaggaagggaagaaagaaagaaaaaggaagaaagaaagaaagaagggaagaaagaaagaaagaatgaaagaaagaaagaaagaaaagaaagaaagaaaagaaagagagagagagaaagcagatggaaataaccatacctagaagggtcagagaaaccttcccaggaagagtggcataagaattgggtttcaaaggatgagtaggagttttccatacagataagaggtaagaatggggaaaggaattgttgagagggatgagtatggacaaaggtatagagtggggaaaaagtggtgtggagagggcatggggtgtagtgggaggagacgaggctagagaagtgggttcccaaagtgtcacctgaccagcagcatctgtgtgctggaaactcttgtgaaatgcaaattatgaggctcccctcctaaatctactgaatcagaaattctggaggtgggactagaatctgtattttttattttttatttttattttttgagactgagtctcaatctgtcacccaggtggagtgcagtggtgcaatctcggctcactgcaacctccgcctcccaggttcaaacgattctcctgcctcagcctcccgagtagctgggactacaggagtgcgccaccatgtccagctaatttttgtatttttagtagagacggggtttcaccatgttggccaggatggtctcaaactcctgacctcaactgagtcctgatttctgagagacagacaacggcatgtgtgtgactgacaagtgggctctgctgagcaccgatgggtttgctgatgggacagttatggagaagaaatctcctgaaagcatcctccaccttgaactcaaactcactagtgaccttggctgagatgtcacttcctctgtaaagccttctccctgccagccactctccatcgctgtgaccccactgcctcctcagccctccccattacctctcaagctgttctctaatggcttagctgtccttccagcacaaggccaggaccttgtacatcttggtatgacatccccagcacactgcctgacgttacccccattccagcagctcactcttgattgagtacttactgagtgtgagcatcatgccacgggctttaccggagctgtgtcatttaaacctgagaactgccctatgaaatgggtactattgttgtcaaccccattttacagatgaggagactgaggcacaggaaataaaatacactgctcaaagccacatggctggtaagccacaggcagcctgcctccaatagacaaacacattttgttgttgttattgtttttgtgcttgttgcaggaagggagggaaagggggagggaaaagtgggatttcctgagcatctttatcacccatgaggtccacagtgccctcccagactgctggctattctcccttcactctgagggacactgcggaaggacctggaagagctgagccttgtccaggagcagtggctgctttatttagggcctaatgagccagtgtctctgctgtgactcagccacggcccaggggtctccagggagaggggactgtctgcaggccctggctagcaactctctgctaacagcacctttcagctcccgctctctcagctgctgtagccattagtgctgaaattagcatcgtaattgccttttaactattcttagctgtgaaagagaccaggctgccccgcctctccctccctgcctagagagcagtgttggcttcccttcctggatctaaggaccaccccctgtccacactcccgagcctcagtttcttcatcctccaagtgagggtgataatccaagcttcaaaggcttattgtgatgcatataaaatgcttgtcatagttcctagcacactgtgagcaatgatgccagttgttgtgtttggagacccaggagtgcaaggatatgtatgcaagtccatgtcataaccagcgttagtgctcaggtccttttgactctgagcttagggctcttcctgtcccaccgtgtcaatccttaaaatgtgcctttccctgccaacaatggcttgtttgtaggctgggcagtcactcttgtaatcccagcattttgggaggccaaaggggaagaatcacttgaggccaggagttggaggccagcctgggcaatgtatcgagatcccacctctacaaaaaattttaaaaattacatgggtgtagtggagtgctcctatagtcccagctactcaggaggctaaggtgggaggatcacttgagcctgggaggttgcagtgagccaaggtcacacctctgtactctaggctggacagcagagtgagatcctgtctcaaaacaaaacaaaacaaaacaaaacacaatcatatgagatgacagtaaacaagatcttgcctgaaaacattcagctttgtcatcataattagaagatttttactacaaaaaaatcaggcctcggtgaagagaggggactcaccccaaaggagttgcaaccactgggtcatctagtttgccctcttaaaagtgtgaacactaacttttgatatgcagcaaaaggttgaagggacggatgatgaagcccagctgcctggttccagtccagttctgccactccccccagggtgaccttaggccagttacttaacctctctgtgcttcggcttcctattctgcaaaatgaggataataatgcctttccggcaagtgtgttctgaggtatgaatcagtcaatgtagtgaagcacctggcacagcagtaagacacagtgagaaccaggtaagtgtttgctcttattactcattaggcatctttacttacttgcttgtgtggcttctaaactgcagtttggggagggggttctgcaatcatcagcagcaaattgtttttaggccagtcaccatcacatggacgatgttttcttacccttggtttagacttgaatcccaatcaggccaggaggggagatccccaggctgaccccgtttaaggtgcaaaaactgaggcttgagaaagttaagtaactttcccaagatacacacattataaaaagaggagcctggccttgaattcggtcaagtctccagtgctgggcaccaagtagcaggcccctcagctggccctgcatcttcttgggcctccccataacccctgtcagcaatccccgtttaatgcgaacaccatatccttccctcctggcggaggcatatctggcagtgcttaaaagcacaaataagctgagattgatatgaggatgaattgaattaacatttatacgaccagtacagggcgtggcacaggatgagtgctaagttagtaatatttatgatgatgatgactattactattattattctgagacagggtctcactctgttgcccaagctagagtgcagcggtgcaattaaggctcactgcagcctccaccttcagggctcaggcgatcctccctcctcagcttcctgggtagcttagactacaggcgcgtgccaccatgcccagctaatttatttatttattttgtagagaagaggtctcactgtgctgcccaggttgctctcaagctcctgggctcaagcgatcctcctgcctcggcctcccaaagtgttgggattacagatgtgagtcactgcacctggcctattattatttagctcggaaaatcaaccctaatgacctcaccggatacaccacttccaggcttggattttaggttccctacacaatttagggctgtgtcctggctttaaatatgtaaatgctgctgtgagaaacacatcctcgggagggagaaggggtgggctcagaacctaagactttccaggaactcagatggggacttgggaaagctgtaaagaagaggtccctgatcttatgaagtttatggaaaactacctaattacaaaattacttcacgccttgaaaaagaacggaatgaacaggacgctatcatacagaataacggaggggtggggctccacttctgatcagagggtcagggaggacctcttggaggcggtgatagttaagctgacacctgaagaagccagtcatgcaaagagtgggtcaacagctttccaaggcagagggaatcaggaaagcgatgggcttgtctgaggaacagaaaggacaacgaacgtgtgagtcacactaaggggcgccgtggtgcggcatgaggctggagcctgatcactcggggtcttactggccacggtgaggagtcagggtttcatgcgcccctgcagtcagaaagcatggcccaaccccagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaactgtaggcgccgccagcccccccttcctgtttccctgggtgggagtgggaagggagttttaaactgaattgtgctcagactcccagcccagtcttcccggagccatccgttccttcatccaatgcggacacccatatctaaggttcgggcaggatttccggggcaccctcaaacccagcccgtgggatccgggaaggcctcctggaggagagtccacgaggcacggagccgaggatggggttggggttaggtcttggagggcttcgaatttccggcaaagggtctgggatggttcttgaggacagcagggatttgcagggaggctgggggtggaggtgggcagaggtcttgctcacatttgtgttctacaaaggtccttttggcttttgggaggcggagactgagactggagtccagaggaccaaggaggacgaggtaactgccgtggtccaggtgggagaaaatgtcggtgaggtcttgggggatagaacgcaaaagaagactagggagtaaaatttacagaaccagtggctagtcaagtttaggggtgagggggaaaatgaggacacccccaagattctgacttccgtgaccatatgggcggggggacgtctcctgagaaactgggaaggaatgagggttgctgggctgagcagatgagggagacctcgttctcccacccccttcctaaccttgtactttccacacctacgtaagtaggccctcgtttcacacaggcctctgttcagcgtcccttcctctgagaggcctttgctgaccaccttttgtaagaccctccccatccccataccctacccactgtttcttcacggcactgaccacccaaagttgtatttggatttgtctattggtttcttttctgtctcccccacaaaactgtgagctccttgaggacaggggctttgctcggttctttgcagtatttccaggacctgggacaccattgcctagtctctgcctaaagaatgcatgaatgaatgaatgaggcagtgcagggtccaggccttgctggttcatcactgcattctgagctgagcactaaatagcaatttgctcaataaatgcatgaatggatggatagttgcttcacaacctagtagataaaatctaggccgggtgtagtggctcatgcctataatcccagcactttgggaggccgaggtgggtggatcacttgaggccaggggttcaagaccagcctggccaacatggtgaaaccctgtctctactaaaaatacaaaaattagccagccgtggtggtgcgcacctttagtcccagctacttgggaggctgaggcaggagaatcacttgaacccaggagtcagaggttgcagtgaaccaagatcacaccactgcactccagcctgggtgacagagtgagactccgtctcaaaacgaaacagcctggtaggtaaaatctagagtcataatgtgaggagcagtaccgtgagataccatcaggataatggattaataatagcccatgtttattgagcgcctccttcacaccagggctgtgttgcctgctgcagatgggttatctcagttagtcctcatgtcatccctatgaagtaaggactcttggtggctccatttacacacatgaggaaaatgaggcccagagaggttgaatgatatgcccaaattcacacagctagtaaacggcagggccaggatctgaacctaaggtggttgcactattaccaagtcacagcacagtacatggatgctatggcttggtggaaagggtcaaaagcatccccacacccagtccaaggctcctcctaacttagatgatttcttctcaaagggtcagaggctccatgttgccccagccaggcccagaacagcagcagaggtctggctgagtagagagatgctgatactaagtctacctggccagtcctcgactgtgggaccagcactccacttcatgtgtgtgttataacattcgatcttcagagcaaacttggtgaggccctcgcggtaatcattcccattttccagatggagaaagtgaggcgtagtgaggtaaaccagcttacctagggccacacagctattgtgtgggacagctggtgtccaaacccaggcaggctgattccagatcccacctctgtgcttcctttaagctgaccacagcaggaggctggatgaggccaggccagctcaggctggccattctcagtgccagatggtggctgccaggcatggctggagcggtgtttaccctgtggccattctgcctctgcccattgagagggcagccctctcaatcatcataaaccgaggctgaaccaagatagcaaatccgcatcctccatcccctgtcactggacaccctgtattcaatcacccacatattcatttcttctaatctttctctcttgactgtgataaagtcacttttatagtgctgagaacgtgcagttcatttgaattaagtctgctggagtagattagtttgtgtgggaaaatcagggctataaaagaaggcatatttcaatggttcttttaactgattatgctctagggtcttattgtaagaatctcatttggggtgtggggtgtgtgtgtgtgagagagagagagagagaattgcacactcacttctagaaccctggagtgctgaggaagaccacctagaagcctccctataggaagggtctgggcttcccttagagaaatgatgaagggaactctgctattatctccatcaggtggtggctgcccaacctctggggaatggggcagataattcactctcatgtaggagggccctaaaagacttgggtgcagctgaagatgatcagctcatgcccaacagagtgcaatggcaaagaaaagtggactgatttgaatgcctccagagccccatctgggaggagagggtaggcagacattgccaatctgagggttattatgcagttactgtctgcctttcctgggagctctttgaagatagtcctgttcatcactgtctgcccagtgcctgaccctttggaggccctcagtaaacatttggtgaatgaaaggatggagagaatgaggagagctggccatcaacaccagctgtctacctgggccaatagagaagttgcccctaggaagggtagacccagcaaaggtccagggcatcagggtttccagacccagcagctcatgcttgacattcaagcctcagaagcaactgtcttcaagggactatgtgagtttggacaatgagcatttcagcagtggccagtggaaatggaagaaaagaggattctccccacatgacctgctctggataaacccttgtgacctttcttccactggcaggggtaggggtgtggtgaagaagcttcattaggacaaattaatttccttcttggccaggtggatggggatttaaaactgaccccatttgattcaaagaaataagtgatgggatgattctggctcctaaaattatggggttaattcaacttatttcaggagtattaaatggggttgtacaagtgcccctggtcctaggagaacctcttttaagttcctccacctgtcaagatgactactttgttacaagagctagaatctacaagaggccaggtctgctagggcctcccaactgatggtacaacagacaacctgtggctgaagggagagaccttctaaaacagccagccttggccagagctgtcatgtctaaggacagcatgtcactagttcccccaggcccctctgcctcagcaccctctcctctccagttacctcctactctctccctccagagaggaattgcagcatggggtgattgatggctatcaggtatgtgattatgcatgtgtgtccaaacccacctatgtgggcatgctctgtgcgtttgtatgtttgctctctgtatatgagaatacgcgtgtacatgaacttgcatgctctgttagggatgtgcttatgtgtgtgtgcacatagagtctaggttctgtgtatgtgtgtgcatgtgtctctgtgcatgtatggactatcacatatagtcacactgtatgtgtgactgtgtgaccacaggatacagggccctttgatgatagagggaactcccccaccacctcccctgcacccagagcaagagggcttgtgttggcaatggactggccttctgtaggaaaagtccacccactgaggggcctaggtagatctagtcacagcctcgcattagctgcttccctgcctcagaattctcctgggtggtcaagccacggagaagcaagtggctcccatagcaggaagaaacagtgacaatctcaggtaccctgtctgaagggacagtgtggtcctggcctgtggttgttcaggattctagtgtatagatggggtggtaacttccaagccatccaccacttttctctcctccaccaatgcaggggtaacatccatcaggcaaggtgctggcagttttcatcctggctctaagtccttaggaaagtcatgtcacctctctgagccttacttttctcatgagatagaaaacctcacaagattgttaagaattacataaaaattaaatcctgtgtaaaatgagaaaataccttctgactagccacttcctgagggcatgggcatgtcaacttatcttcgtgtcctcgtgctttgcctgggatctggtgtatggcaagctctcacctcatatttctataaacaattttgaaatatgtaagcctttgcagcttcccaacataaattcattcactcatttattaattcagtacacttttatggagcatctactatatgtttgacactatttggggtattgggaatagagctgtcaataaaagggcttactttctagtgcacattagcatactaaaggctctgagaagtccagcagtaccaggtttctgataaactttgtttaacccagcagtctctgtgtttaattatggaattccccacacctctttcaaccttttttttgctaatatgcaaatttaatcctgttccattcctcattacctgttacactcccaactctaagccccttcagaagggctatggaatataataattaaaacaactactctggagccagacacctgtgtgtgtgatcctgggtaagcctcaatttattcatgtgtaaaatggtgataatggctaggattaagtgagataatgttgcatctccaatgctcagcattgtgcctggaatgtagtataattcatttaaataacacctatcactccaggtctcctcaacacctatgaggtaaggccaattgtcctacatgatacccaatgccctaattgcctccccagagttatctgaaatcattctcctccaactctcttttatgagctggtcattcggaaccacttgccagttcccatggctctcaaacagccgcctgttgtttcatacctttgctctcatgttgcttcctcttcttaaaattttcttctcagtctttcctacctggagaacatacattacattcatctcccgagtcatcccctaatcacctcctccattaaacacgtactcactgcctgatccttcagccccaactgatccaccagccaactgtatttgcatgagttatccaggcaagaccagtagaggaatcacccagttcatctacagaatcatgagaaaataatatgtcattattgttttaagcctttaagttttggaggtagtttggtatgcagcaatagacaactaatgcaagctccttgaggccaataataactaacttcaactcatcttcatctcgcaccttgtcattcagaggagtacatggggacccctaggaccattggtgaagccaggagagagtgaatgcccttggttgtctccattccagactagaggggggataaatgagggacctccactaaaacatcagtggaaggaccctaggaagaatgaactgtctagagaacagaccaacagatcctcagcggacactgtgagctgtccagggtcctgagtattctgttctaggggaacacagtgccatgctctgatctgcccactcctgtgccagggtcaccctactcaagacccgccctagtgattgttatgctgacatctgagagaaccagccttatagtgggaatagaggatttgacatctgctcaaatggaattgaagttgattcttacaccttcacccttccttctcccttccaccctccctctcaggaacgatttgaccattataataaaaatccagctttatgtaaataccctatcctccaagtaataaatgccattagctgagcctgactgagcaatcgcatgcttttaaacatccatttgaagatctttgaaagctctctcgaggctcttgctcataattcactaagtgggagttggtaataactgtgttaaatggccaggccctgcaattcgcggaggtgtgtctgtttgtgtgttggtggtggtagtggcagggggtgctgggaagaggatgcccttccttccatgctgatcggttacttatttttaagagtcccactgggggctcacagtcctttgatgagctactaatgaaagagccagatctaacaattaatttccccagagttattatttattgttttggcaacatttctctgaaaagccttaatactcacctggcttcctgatggttgaggagaaccatgggttgagaagagaaattagttttacctgtttattcaacaatcatgaattgagcacctgtgtgtgccaggcactgcactggagcaagatacacccctgccttcagagagtccccagtttggtggggggcaagatagggaagggagcaggcataacaatacagtctaatacctatgatagaggggacaatgtagggggctgtgggagccaggggtggcacatagccaagattgaaggagtcagggaaggctacaagaggaagagtccttaatgatgacctagagctaacaagataaataaaaaatagggaaaggaaatactgtgagaagaaggaccagtatcttcaaagactcttagaagagaaagagcatccataaaattctggtgagatagtgtagtactgagaactttgtcactgctggtgggagtgtaaatttgtatagccatttgggtaaacagttggacgctatgtagtaaatttggagatatgcaagcccttcaacccagcaattccatttatgtctagagatacttctgtatgtatacaacattaggagacatatacataataatcagagcagcatggtctgtaataggcaatgactggaaacaaccaaaaacctatcaaaggcagaatgagtaattgtggtgtaatcatacaacagaatactatacagtagtgaaaatgaatgaaccacagtacacttcacaacatggataatttttatattgacacaaatacatacaacatgacttcatttatattaaattcaaagcagataaagctgaaatattgtcctgggatatttactaaggtggtagatatataaaagaaagcaacaaaatggttgaccatagtgttttatttcagggggaggaagggacatgattggggtggatcacatggggagtctcaggcgacatatatgtcttgatttgagtggtgctcacatagatgtttagaatttttaaataaattgtgcacatttatatcttttatatgtttctaagcttgtgatatatttcaatatttttgttaaaagaggcaaaaaagcatcattgtagcctgagtcactgggtccttctctgaacataactgtgagaagcctggcacaccaatgggagggctgagggtggctctcaggggaccctctggtgccagcatccttcttggctgtgtttctgtgtggtgaataggcaaccccacaatggcagtaccaagggccacataggatctgaagttcttttggatgcttcttagatcatctccatgagatatggcatggctttgtcatccagaagaccaccagatggctaaacagtaaaaaagagctttataggtaatatcagtttgtaagctgggaagagaaagtctccagcatggattaaaggtgctctctctttgaagagagaaaggacaggttggattttctgcctcacagcgtccatgttacacaatagagtcatacatagtcagcaggtttaggggaaaaggtatatacattcatgaggggagctgagcacatccacgcacactaggtaaatatgtatgtaacatacatcccatgttcactttggggtggggttttagcattaaaatgaggtagaatttggctctttatatcaaaaggtgaactataggacagaaagatagtttgcacacagcctctataagctagctgaaaatggcttaaggtctgcaattgcttatgataaaagaatgcaagctcagtcctctgtctagtcagagctgtagtggtctgggttgtaaatcagagctaggaggggtctgatagctcctattgttagggagcttagagctataggaatttagaaatgtgccaggccagtcaggacctgaacccttaaccaataggtaactttgtttccttaacgtttgggttcatcttagttgataaaggggcatctattttggcctctcagatctctccttagtttccagaggaccccacatgggcctgggtgtgagtttcacagggtaaaatggagtcaggtgatgctctgggagaacctgagaagagagacagcattgctttgtctttccacttgcaagtccccaggatgggttaggattgtaaggtgctatctggccccaaaatccaacttcagggcagggtctctcctagatggactctgcagtgggcacactagaatgaacattgccatgaggatcttgcctggttccaggtgactctgaatctttaacataaatggaccttgatcccaatctggggaagaagatgggtgttcccaggttgtagcagctgggaaggatctcagtggtctcttgtatccagcccttaggactttttggcttttgattagctctcaagccaactttatagttgttcatttataagagtaatatattctttcagaacaattatacaatgtggaaatgaatatagaaagtattatggtttcccttataatctcatgttgcaaacaaacaaacaaaataaacaaacaaacaaaaaacaatattaaggccgagcttggtggctcattcctgtaatcctagtactttgggaggccgaggtgggaggactgcttgagcccaggagtttaaagccagcctgggcaacatagagagacctggtctctaagaagaatagaaaaattagccagatgtggtggcgtgcacctgcagtcccagctactgggaggctgaggtgggaggatcgtttgagcccaggaggttgaggttgcagtaagccatcacacacaaaaagtaaataaaaataagaaaagaaaagaaatcaatattaatagtctggcatattttcttccacacattattccaagctcatacacatatgtacaaacacagtctggagctcatacacatatatacaaaaacagtctggagctttcttcttttttgtttcgaaaaatgggatcatgctacgctcattactctgtgatttgacatttcacattataatagatcatggatatcattcaagatcagcccttccagatctaatagacttttttttttcaatagctgtataatattccccagtttggatgtagcagaatttactcaacctgtccgctgttgatagacttttaagtaatttccattttttgccactacaaataatgttcaggaaacatccattgcttatatctacatgtcctaatgcatttctttgtgtaggataaatccccaaagctaaactgtgagtgaaagaatgcacttttctattttaacaagtcctgacagattactttctcaagatgttgtagtctttcacacttccaccaatgacataggacattctcatttctctacaccctacactggctgctatcaactcacaacgttctcttccctcaatatgatgagcagatgagcaaagcagaaaaacagcagaaataaaaacaacaccaaaacttattttattctatttgcacttatctgattactattaaggttggttattttctcaaatgtttgttcattgtttgtattttcttctccaagaaatgcttattcatatcacttatccatctttgtatcaggtggtttccctttttattactgatttgctgaagatctttgcatattaagtgattaagtgtgtctcttgcatgatccttcatttataaagatagaaaatgataaatgataacagaggggaagtgagttgtccaaggatatgagaatgcaagtgtcagtgctagacagggtcatgcctctagattccctgcccagggtttaatccctggcccgctccatagctcagacccttgtggacaactttctgggaattaccagaacacattttctcagagtatgagctaaagacttccttcatcagaattatctggtgcttcattaaaattcagattctgggaccacatcccaaacctatttattgagtcagaatctctagaagtggggccaaggaatctagattttaagagagctttttagattgtccttgtatccaccaaaattagagaacaattaccccagaaactcaaagtccttgcagaggcactgagtgggaagagaggggtaggaaagctaatgggaacattgtgtagcgactcccaccaccaccaccaccatcaccaccagctgaagaaagagccctcaaggttgaagcatcaaaacagagctatcactggggaccttttggcctaattctgcccttaagccacaatcaagcctttgtggcagtaggggtgaatgtaatatatcactttcttatcggtataaaggtgtaaatgtcaatttctcctcctttttgtgaagatttgacaaagcacttagagcgacacccattttaatcaacaaagcagccagaaagatcacagggcatcaagtgtgccatatcctatctgagctttgggtggatttgaaaattgcacttttaattaaaattggcatttccgcagctcagattggagctcgccgttttgctagggaattgcaaactgcgaggcaaacaatctgagagggaggtttaagaatacgaagaggaaggcttgtgtatgaacaggaggcgcttgtttaaataatgaagcggagaaaagataatgtaaaaatgcctttgtctatgtttagttaggtttcctcagagacccgggtaattgcggctgagctgtccgaggtgctgacggctgggcgagaggagcggttgaatgtatgcacaacgcccagaggtaaatgcctggtccacagttctcagcccaatcaagtttgccctgctttatgggtttcttcttggccaatgacaaacaaacttccaggcaggtgattagtaacttttgtggattgaacgaatgaatgattgctgaccacctactatgtatagtatatggtgctctgaaaaatgggaaaaatgtcaaccgaaattgttggatccttttcttgtgatgttgcagtcaacctcacaattgatcttgttgtgagatttcaggattttgtgaaccagaaaaattgcaagccatcaaggacaatgccaagcgaagacatttaagagtaacaactatcacctgttctctccaatgcttgaataaaacaaaaggcattttaaaacttaataagtaggaaagccataatctcagaataaggaacagttatttagaatggttttgtaaaaacttccttgtttgcccttttttctaatttcattgagaaacacaggaaacatcaccatgcattgtcatcagcttcaaaactggcatttgggagtcattgatctgggtcctcaggaaagaaatagaatctctcaaaaacatgttaatcagaggcgctctgacttctggctgcacatctgatctccagggttagcctgttttacagttttattagaaagttctttccatagttacagtgccttaaatatgtgtgggagagggtctggggggtaggcggatggattaaaattgacacttgttgagaacccactgtgtgcaaaaacttaaactgtcttaagatgctacacttaccttatcacacataatctggtttttgccctcatttgttagataggcatcattaataacccaatttaaggatgggaaagttgttacacatcagaatttaatttataataaaagaactttcaaagatcaacttagaagggaacaatttgtcaataatggtataaagataattgatgagaaaaaattattttgaccttcacaccagagcagtcattaaatacattccaactgaattaaatgcctaggtgtaaataatataaacatataacatatttttgtgcttcttttttttctttgtttcttttttttaaaaaagggatacatttgcagaacgtgcagattggttacataggtatacatgtgccatgatggtttgctgcacctactgacctgtcctctaagttccctcccctcaccccccaccacccaacaggccctggtgtttgttgttcccctctctgtgtttgtgtgttctcaatattcaacttccacttatgagtgagaacatgcagtgtttggttttctgttcctgtgttagtttgctgaggatgatggcttccagcttcatccatgtccctacaaaggatatgatctcattcctttttatggctgcaataaaatattttttaaacatagataaaacccagaaaacataaatgtgggtagtcatcagatatcataaggtaaaagggcttttcaaaacttagcaacaactgaaaaaaaaaggaagaatgaacaatgttaattgctgggatgaaaggattctattagacttaaatctccttttgtaaaagttgatattttgcaaaaatgaacatttcaaattaaaacagtgaaatccatagtggttacttctggggtagagaagttgaataggaatcttatggggaaaatgttctctatttccatatgggtgaaaattaattgaactagatatatatttgaaataagcacactttactgtgtacttataccttgattaaaaagtaaaaacagaaaacaaagtgaaaaccattctaaatgcaatatctctgttttgaactaccgaggggaaggatatcaggttcccagggtagtaaaacctcttgaaaccattgtgtgttgtgtgaatacagtccactgatttaaccctagtccacatgaaaaagatttgaagattctagttgaccacaaactctagaatgtcaatcatgcaactcaattagtatcaagaaagcacacaacccaaggttttattgctaaaggcatagagctcccaacaaaggaagtaagagacacctagcttaggaccatttctctgacagactgggtaatttttgaataaattaatgaaactgattgtctttcaagacaatatgtaaggacagaggcaatccagcctagacgttggagtaatattggcctggatttcaattccagatctgccaactacatgttgtgtgaccttaagaaaataatgtcatttctatgggctcagtctcctcatctgtaaaatggggataataataatataatcactgaaaggctgttgtaaggactaaatgaggtactatatataaaactctcggtgtagcgcttgacatattctaactctcccacttcagtgacagtttttactagtggtattaacaatgagttccagggtgggaccctccttgtatgtcatctccatgtgattcctaaggaagtttgttttctggggagctggggaagttgtacaatctttgctaagaaaaccaagttgcctcctgccacccacatctcaccactgccctagagataccccagatctcttgtggtcttgtttcccagtgtgaactgctgcaatcagtggccaaggctgcaagccaggcagggaaggggactgtgcaggagacagaagatgaagaaatcgggaatccggcacagcagcgacaggagctcattgactcctccccaagggccagctcgggaagctggagaggcctgtcattaactctctttattatctacattttctgcctcactggctcatctgaggctgcaaatgggactcactccttgcacgaaccttgcttcattggattctggaactgggaggaactgaatcacggaaaacatttatcaacttgggggttaaatgtgggagatagggaactgggtgtgcacataatatggagtttgtccttggaacttatcctaaaaggatcatggtagtttctaccctaccatggcttcttctgaacccagagtctcctaccactgccatttggaggatcagccatgccctttctagccagattcatatagctcacctcttgcattttaagaactgtgtctatatggtagtctcctacaagaacaggagcagtgtggcatgggtttatagatagtcatgtgctgcttacaactcatgagaccttagactctctgagcttcagtctctttctctgtaaaatggggatgattacatgagccttgaagtgctgggtaaggattaataatatcatccttctttattaagcatttaccagactgtaagtgcttgaacatgagctatctaaatccaattctcagaacaataggtaaatactattatcatccccattctgcagatgaggaagctgaaacacaggttaaataacttgcccaagataacacatctctctcctaaccttcctgcaggaaactcatctattcccatgacttacaagatcatccatagacaacagctcctatgcttattttttcagtcctattctctcttctgaggcccagcctacttgacttgtcaacttggaggtttaacagatctttcaaacccatttctcccaagcagatgaagacactgaggcaacttgttcaaggtcaaacaactagagtcatcaagcccgaatttgaacctggatctctctttatctgcaaaggttacactgctgagcacattctatctctctatgagttggtactctcttcaaaatatccctgtcagtcagacatagtggtgcatgcctgtattcccagttattcaaggggctgaagcaggagagtcacttgggcccaggaattcaaggctgcagcaagctatgattgtgcccatgaatagccattgcactctagcctgagcaacatagcaagatgccatctttatttttactttaaaaataaaaataagtttaaaaataaagaaataaaagaagacccttttccattctgtagctcataccctaagtcatatctaccagactgctgtgatactcactaaaccatgccaactgctctctcccccaagctaaagaggccctgagcaccagcctcaggatgtgccaagaaagaagctatccataaggacagagggaagccccaaagagggctcatcagagaaagtcatggggaagaagagctgtgaagccatcttatctccttccatcaaaagcccctgttctggctgggtgcggtggctcacgcctgtaatcccagcactttgggaggctgaggcaggcagatcacgaggtcaggagatcaagaccatcctggctaacatggtgaaaccccgctaacacggtgaaaccctgtctctactaaaaatacaaaaaaagtagccaggtgtggtggcacgtgcctgtcatcccagctactcgggaggctgaggcaggagaattgcttgaacccgggagacggaggttgcagtcagctgagattgtgccactggactccaccctgggtgacagagcgagactctatttcaaaaaaaaaaaaaaaaaaaaaaagccccgttctgtagctcaggaattatgtccttgaggatttaaatgtgtgtgtgttggggggagggggaagggtgccttagggaggatctctgagcttcccccaaagagttacagtgtatggcaactcttatttatcaaggctgtgtaagccttcctccatctgccaatcatctaccttcttcccatccagtgttaatctccctagtagcacatgctctgtcatctccttgtacactgagtgttatcttcagtgtgaaacacaggctcaggcactcagatcaggctatgctacaaagtaatgaagcacttcttatttccaaagaaaaatagatggagaaaactcatccttaattaataacatgtggcaagtatctgccctgtgtgaccacatggggcctccatgagttccctgtatggtctagagagaaaaggggattttcccaaggtcatgaaaagttgacagcaaagctggagcttgactttgggggctttctgattattatctttacctcagatcagccaaacacacaaggagtttcctgagatagccttgcatgtgacaatctcagaggtccattttcaagcattcaagtcttgccccctcctcaggaatcagccacagtatgactatgggcagcaagtcagacctcaggtcttccccaaatagcccattttttgcctcatggaagcaaaccatgccctagctggaaaatccaaaaaagtgttttaagctaaaaaatgaaacccagtactctccttttgcaaacataggggcatgtaaaccagtaagtttaagaagccaactcatactaaaaattcaaaaagatactggatactcaaggtgaaaggaggagatcagaaaggagtgaaatggaaggaaagttaagctgggatctacttcctcccaaggttacagacattgctatcagctggcagtgcaacttcaggctagttattacacctcattcatactctgtttcctcatttgtaatatggggaatctgatagcaactatgtcataagggtggtgggtgggctaaatgagttgagttctggcatataagtaacttagcatggagcacaacaaatgcttactttgtgtttgtcgtcattgcttccaagttccttctttggtctctattggtgtggagtatctcattgcttttttttttcacagattttcattctgtcacttaggctggagtgcagtggctcaatcatagctcactgcagccttgaatttctgggctcaagagatcctccttcctcagtctgccaagtatctaagaccacaggtatgcaccactatgcccagctaagtttaaacaaattttaatttatttttatgctattttatttattgtgtagacagggtcttgccctgtcaccctgggctggagtgcagtggcaggatcttggctcactacagcctcaatctcccaggctcaaatgatcctcctgcctcagctccccagtagctgagactacaggcatgcactaccatgccccgctaatttttgtactttttgtagggatggggttttgtcatgttgcccaggctggtctcatctgccttaactcaagcactccttctgcctcagcctctcaaaatgctgggattaccgttgtgagccatcatgcctggccacatatccttctttatctaaggtcagaagaacctttaatttcaattaaccttccttggtcaaatagtcttttcttcaaccactggccaagctgaaagtagagactaaaaaataccacaccattatttggccagcaaagaaactctccctcccctaccatcaccatttcctctccttttccttttgcctcttccccctttccctccctttctcctccctcccttaccttctcctttcctcctttcttccctgcttgctttggcttaatgaaaggcctcacaggacgctgtccgtggtgctgacttgtttttctgtcttgttcaaactctgtatgcaaatgaaaagacaacacagctattgaatgttgaagctggggacattccccaagctaatctctgtgcctgtggtgtggccacggctctggccattatctctggccacagtgccccggagatgctgatgctgacctggaccagaggtgccagcctgggcactgccagtccccacagccattgactagagccccagggcacaggcagctagcaacttatctgggtgccccagggactgctattggcaaagtgatggccccacagggaccaaatgtgaagctaaagcaggatacgcaggtcggagataaggccaagaacagattccctttagcgctcaagtgctgtttgtcagaaattgacagccccacggccctggccggtgacaggcacagggtgataacaataccatatgatcagcatcattggaggacaggctgtcactggctcccagagataaggaaacaatgggcgacccctctgcctagggaaaggcctgcatggagcccccagggcaaagcagcaagatctaaagtgtgtctctgacccctggcacctcaccagcaccccctcctcccagcaggcccccagagctccttcctgtcacccagggacccgtggcctccattgtgcacccactattctgacccctgttctctggagttaatcatgttatctctagagcacaggtgttagtggatgataacagacaagcagttccctccccagctccctgcaccacagacgctgctaagggaatggagtgggagaacagagctttctcgaggtggtttatgcaggccatggattcagcactaacagcctctctccagcactggattcttgagaaataaaaaggttgggtgtggaggggctcccacattttctagtgtcttcccattccaccccactggagcaaagctgttgaccctacacttggggacatattttgggatgggttccactgccctggcttggctatatcccttcccccactgctgcgcaacctttccctaccatagccccaatagccatgaaatggggactcagcacacctaggtcctagttctttccctgaccccagcttgatgaatgatttagggatcatagtcaagtcacttcactccctggcctcagtttcttcaactgtaagttggggctactcatctgtaactatcagatctgccaggtggtatgaagttccagtgagataaatatatgtgagggctgggcggtgggagatctgagatttaccccccactaaccaggcccactgagtacagtgtggagcactgctgggtctcagcttggaggtctgctctgcctgactccccaggtggcaagatcatccccccgttcccctcctcttctatgcttaggctgtgatttctcatgggctcacctctcataccctcctgttttctttctctcatgtctgtctctcaactggttcttgttcttgcctttttttctgatcttttacgtatatctgcaaacctcactctgcttcctcatttgttgctgatgcagaaagaatgcaaaggattatttatttagcttgtattttggcaccattatggatgactttgatgttgctttggacaaccatccagcaccctggcttcgtagttttttttgaccctgtcaactccaatgacctccacccccttaccccttcagttcgtgcctgcggacacattctagactttgtcatcacccacaacttacccgtctcgaaaatattaaactttctggtgacagctcctgtgttcttcattctctaattccactctgccttctctttagcatcactaagatctctagttctttctgtctccatttcctaccaaaatgcttgccctttgcttggtctgtttcttttctaactggccaagatcccctgactcatgtcaaatatgtccctgcccatgcgtcctttgtccctctgctgccctcatttatttacttcattcattcactcattcattcattcatccaatacatttttagggctggtcaagggaatgggtggtatttatacaatttttttttttgagacagtgttgctctatcacccaggctagagtgcagcaatgcaatcacggctcactgcagcctcgacctcctgggctcaagctatcctcccacctcagcctcctgagtagctgggactataggtatgcaccaccatgtccagctaattaaaaaaaattcttttggtagagacaggatctcactgtgttgcccaggctaatctcaaactcctggcctcaagtgatcctcccacctcagcctcccaaagtgctgggattacaggcatgagccattgtgcccagccccagcacatttttattgtgcatctactatgtgtcaggcacagtgctaggatctagagagcctatggtaagcaaaatagataatagttatccccttgagctctagaattcaatccaattgaattcactcttggctattatatttggggtgctgatggttccctgtgaatttctggtttctaacattctctggaccctcattgttactgtccaatcttttatttttttatttgtttgtttttgttttttgctgtccagtcttttaaatgggtgctacattgggtcagtagttctagacattttagtgtcctgacacatttacaatcccccctttatttttgagacagggtcttgctttgttgtgatcctctcacctcggggcatcccaaagtgctgggattacagacatgagctactgtacctggcctacaaatcttattgaagttataggcctctccccagaagagtgtccttgcatatacattccactgacaattttagaagtccatgtactccataagcccagtcaagagcccataaattagacaaattctgcaaacatattcaactttttggcctaagaattactaatctcatcttgccttcaacccatacaccaacatttttcacatcaggggcacagagggtaaggggcagagttcgggagctcaattgtggaaacagagatatgaatgaagatgaggcaggtcttgttcattctctctaaggtgtataatagcattaaaaaatctttcttccttagtcacttcccaagagtgttgaattggaaaatgtgggtgtattatcttctgctgggcaaaaaaaaaaaacaaaaacaaaagcaaaaaacactcaaaacctagtggcttaaaacaacaataaatatttattacctctcacagtttctataagttgtgagttcaagagtggcttagctgtatggttctgctttgggtctctcataagtttgcagtcaagatgtcagctgtcttctgaaggcctgcctgggactgagggtctgctttgaaggtggcttacttacctggatagcaaattggttctggatgttgtcaaaaggcctcaatccctcctcacatggatttcactctagggcacctgagtgtcctcacaacatggtgactggcttcccccaaagcaagcgatccaagagagagcaaggtagaaactgcaatatcatttatgagatagctttgggagtcacatctcattatttctacaatgtctcataagctttttttttcttcttaagcggcaggatattgctgtgttgcccctactggacagcagtggctccatcatagcttattgtaacctcaagctcctggcctcaagtgatcctcctgcctcagcctcctgagtagctgggactacaggtgcacaccaccatgcctggataattttttctttctttcttttttattgttggtagagatgggggtcttgctatgttgcacaggtgggtcttgaactcctggcctcaagcaatcctcctgcctcagcctcccaaagtgcagggattacaggcgtgagccactgtactcagccatatcctgttgcttacacaggtcagtcctggtcagtgtgaaaggggactacccaaaggcatagataccaggagaggagaatcactggggccatcttggacaccggctacaattatgggagatattcccagtggggaaaccgtgatatttgtgtataagttattcataagttgagactttctcagtcacctctgcctatgcttttgagggcatctattagtcttcaattgttcattttactttgcattccaacacacaaggttagctagcaaagcatatttttcttctgttacaagtgcaggtgtgtaagttatcactacattgggagtaatgaaaacagccatcctttatgtagcagttactaagtgccgggcactctcataagcactttatatatatattaattcatttagccattaaagaaccctatgaggtagaagttatccttgcccccattttacagatgagaaaacggagacacacaaaagcaaagtaacttctgcaatgccccacagctagcaagtgccaaaggagggattgaaccatagcagtctagagagtctgtgctcttaatcaccactcttgaccaccagcagaaggggttgtagatggtgtggaatgtagacgtacccaagttctcctgggggcattcagagagagtcagtgactgagagccagagagtgtcgacatcaagggcagagcatgggaaggagatgagaagaggcaaactaagaggcaggaaaagaagcaggagatgggtgtgtgctggaagtcagatgtgagaggagcaaatgtgggcaagagcgagcggcccaggccacagagtcggtgagcagaatgaggatgacatcggaggtcctggatgaagcagtttggtggagtgacgtgtggcagccaggttaaagtgggttggaagtggatgggaggtgaagtggcaggtggaccactcttgggacagcccagctgtgaatgatgggggaggcatggggtgagtggagggagagagaaagggccccccagccagcaggagatggggatccaggagagatcccagcctgaacccaggcctctcacccaggccaagccgagcagaatctgttcttccgagaaggaagctcccatcacagtaagtgccaaatgaggcctgaagacgcaaatatttgttcggcttctgcccttcttgttcaaatagggcattctctttggggatggaggttggctgctgcagcgaagaagtgagaagtcagtaagggtgggagggtgtaaaggaggagcaagtgctctgggggccactaatgaattccccaggctcctgagccactggaatccattagctcatgaaagcagctaaataataccccggctgctttatgagacatctgttcaaataaagcctacctttctcctcaagatcagacttcatcccactccctggtgcccatcctgctctgtctgactgcggctgaatcaggggttgtatgatactgcctctctgcacccccgctacaagactgtgtgttattgtgtgagggtgtgtggttatgccatgaccgtatattactctggagctatgctctgtgtgggtttctttttgccagtgtataggagtccactcatcgactgaattactctgtgtttgtgtgtgtgtacacatatgtgtttgtgacactgtctcgctgtgcagctgtattatgtggtttgtgactgtgttaccctaaggctacatgtctgggatcttgtgttgctctaagagtttctttctgtgctgtgacaatttttgcctgtgtgttatcgtgatacagcacattactgtatgtaatttggtggtccactgtgagaggccacctctgtgtgtgtgtgttcatgtgcacatgttaccgggggaggtccttgtttttagagctcccaaaatggtggtgggccacttccaagatggtggcaagcctcctgttctctgacctggggttcttggcttcccggattccaaggaatggaatcttgggccatgtggtgagtgttatagctctattagaagccgtgggtcacagaagtgaaccgtggaacccagcgactagcgttcagctcaattaggacgaacccaggcacttagccatgcaggaacaatggcgagcctctagcccgatcaggagctctgttttcactctgctaaatcttgcaactgcacactctttctggtccgtgttggttaaggcttgagctgagctttcgcttgccatccaccactgctgtttgccgccctcgcagacccgccgctgacttccacccctctggatcaggcagggtgtccactgtacttctgtccgctgcacttcacagtcaccttccccagctaggcttaggaattcttagtcggcctaagaaatccagctagtcctgtctctcacacacacactgtaaatttatcagtgacttcgcacgtggctatattacgctgtctggtgtacaaaggtacacgtaaatgatgtgcctgtgtgttactctgcaaattgggtattgtgctacacacagtgaagtcatgggacactgtgttttagtgggacactttgttgtgactgcttgtgtgcacagaaggacctaaatctctgacttcccctcccagtggaccaggaccattctgaggagcacctggacagatgtggcgaatgtgaatgatggtatgtaggatgggcaccacttctcaactgttggataaaggtctaagccttaaatctcagaaaggatcagtccagggcagaggcaacacccaagaggcagccagtccagtagctgggcaaaagaaggagcctaggctgggtgtggtggctcacgcctgtaatcctagcactttgggaggccgaggcgggtagaacaaggtcaggcattcgagatcagcctggccaacatagtgaaaccccatatctactaaaaacacaaaaaattagctgggcgtggttgtgggtgcctgtaatcccagctactcaggaggctgaggcaggagaattgcttgaacctgggagacggaggttgcagtgagccgagatggcgccactgcactccagcctgggtgacagtgtgagactctgtctccaaagaaaaaagaagaagaagaagaagaagaagaagacttcagggaagcaaggtggtcagctggtagcatccaagcccaaggaggcaggtggacaggtgggggcaagggcagaacctgggattccagaacctgcaaatccctgctgtgtccatgatgcaggggggttagactagcaacatccacatgcatcagaagcactggggaattttatctaaatggaccacaaccaaagattctgatttactagggctggagcagggccctggggtctacatttataccaagactcctggctagtcaggggacctcactttaagaaacactggatcccaggctccacaaggaaaaggtgagaaacatgaggcacagtaagaatctagagggggaaaggaagaaaacaagagagaaaaaaaggagaaagggaagaggagatggagaaagtgatgtggcgggcatcgttggtgccctgcccatatctcctgagcactggtcactctagtttgcaccctgagtcctatgggttcttcacttgaggactcttggattctctctctctctccctctctctccgcatccccccactggaatcatctgcaaaatcagctattagcactcacattgttgtctcagtgttggcttttcaggaatcttaagacaggcgagggaagaaatccaaaaactcctcagcctgaagcatccagctgaccagcaggagcaacaacaagggtgtggggtggggctgccaggctgctcctcccattggctgtttgagcttcttccccacttcgggaggttgcagctacttattcaggtgatggctctctcagtagacctgcttcctctctggtcttttggatgcctgatcattttaattgattgtcagaagtctccacttccaaagcattgttcttgaggccacaggctgttgccgccatgcctggcagccagcagttccactcaaaggccccttagccccggccaggggaggtaacagctggcctgggcagaatctgccgaaacccccgcccggcaactccagttctggaggcctctttccagtgccatctggatggaattcctctgctcagactgtgtttggagcaatgtcggcatggtcaggtgttgctgctctttgataaacccagcctgtctcccttgggcagccccaccatctgctttgtctatttcctgcaggaatgtactgcatgaataaagacccctctgtggtgggacccagctgcccgaaggtcagcccctgtgaatagagagcctgggctttgttcaggggtcagtttgatgacagcctctgacaagtgcccagcacttcccagtgtataaagcaccattccagcctttcccccagtgctggaaggtggggattttgggtctgacccatgggtccatggatcttcactacaatagcaaatgaatttcattttgaatggtgacccgatgatgggtagctacccagggccccacagtgaggattctgaagctgtctggacccagaagaaaagattgtgaagtgacttgacgcaatgtcctggagcctggagtggggaacggtagcagactgctgatgccctcagccacctccaagttcttctcaggcctgggtggacagtcccagggcctgctagcagctgcccatcttggatcctcacttcatccttctcagcctgaggtcttcctctggtgccatgagagctagtgcagtccactcacagggcaacctggaagtgccagagattttaacaaccccgcccccagggtgagggcaacctcaacctatgagggatggttggtcagtggctaaaggatccaggttctctgccccttgctgggccaattctgaggcacattctgcaatattgctcagagtctccaatgtgattgagccccagttgcccacagcagtgactcgctcattagtgcaccttgactggctatattccccctcccctgcccggtctccctttcctactccctcaccattctttctgccatcacctcacaaacaaaccacctccactcaagtcctggctttggggggaacccaaactagagcaagagtgatggcaaatgtgtccacctcccaccccatagtgggcagtgacagtatttagtagcattgaccttttgccagcactaggaactaaggttgggaaatggggaaatgaggccaatgggtcgggaccatagcctttgtttttttgttgttgttgcttgtttgtttgagatggagtctcgctctctcacccaggctggagtgcagtggtggggtcttggctcattgaaacctctgcctcctgggtttcagtgattctcctgcctcagcctcccgagtagctggaattacaggcacctgccaccacacccggctaatctttctatttttagtagagatggggtttcaccatattagtcgggctggtctcaaacttttgacctcaagtgatccacccaccttggccccccaaagtgctgggattataggcgtgagccaccatgctgggacagggccatagcctttgaaaggccccatctgctggggctggtggacacccacatcggtagcatcaggaacatactgtgtagtacagagcagggggctgtggagaaggatgcacgtgcctccacatggagaggccaacggaggctttctggaggggatcaagtgggctgagacttactttggatgggaatcagtccttggcctttgtgtccatgaagtgtcagctcttcttccaggagggctgtcatcacctcctacttcctggactggatggctttccccttgcattggctgctacggcacctgaacctctcttttgtggcaccccatggccagggggctatttgctggattatttgaccaaatgtctagctccctgactagattacaagcttcatgtgggcagggactaggcctggttttgttgacttgtcagttcccagcaccaagtgcacctccctcctgtgtcccctctgccattgctctggccccaacttcattgcctgtcatttggataattgtactagtctcctcactggtctccttgcacctaaaagccaccctgaagggactgctgtgtcagccctgctttcccaacccccagcagctatggtcagtccccctcctctgtgcagaggggccaattctgacccagatcaaaaggtctggggaactccgcttccacccacgggaccagaatgtaagaaatgggattatttcaactgcgtgaattgttcccagacaccccagtaagtcctgacaccttcatcacccactgagccacagccttgccccagtagtgtcccagtgtacaagttggggagctgagtcggagctgcctccttttgagtttccttctccttggatttctcctcctccaggaagctgtgttagatgcctccttggctgcaccaagaaggtagtatttgagtaaaaactgaaggggtgagggagtgagccatgtggatgctggaggagagggttctaggcagggggatagtcagtgccaattcctgaagcaggaagagaaccagaatgacaagtagcagcaagctgggtatgaagagaaagataagaaatgaggtcagagtaggggaggcagatcccacaaggcctggtgggccaccctgaaggtctttggccattgctctgaatgagatgggagccactgaaggtctttgagcaggggaggccaggatctgacccatgtcataacagcctcactccagattctgtattgtgtggagattgcaggaggggttggggcaaaagcagggagtccagactggagacattggccagaattcagctaagagatgctggtgttagtaacatgatgggggtgataatgacatgaactgaccaaaatctagatcacagattcatggagtataaaaagctgactttcccaggcccgtcttttcctgggggcagtctccctttggcccgatgccctggcccaccctatatggtgggttgatggcactgtcactcctgcaaaccctgctcctgtcctcactccaccaccctgctgcatgccctggaggagacttctgggacactgagcccctgcccatcaggcccttccagatctgaagtgtctggccctgtagcagcccagctcccaaattctcacccctcctcttctttaaccttagctgcctgacccccttatggacaggagtccctgctcccctctccggcctgccccaggctccagccacatcaaaaggcttgcagttgcagttgcccaaatgcaccaggtctttcccatctctggaccttgctagaatgcccctccttcaccctttttatctaaacaactccttctatttcctcaagactcaacccaagtgtcatcccttccaagaactcttctgaggccccttcaaattgggacatccctttcccctattctcttagccacaacactttctctggggaactatgtctccctcacataactctacacctaagctacctgaagtgagcccacctccatgaacttgctccagtccgtggctccctatgcctgatgtttagaacacaatgcaactttatcttaccttccagctctatcttccacacatgccttctgccttctccagctcctaccacacttgacatcccccactccttcgccatgagttttcccctttcagtggatgagaagtggcccaggatgttcccagtgacacattagcatgtgccctatgcagaggggcaggatggactttcagatgcctgggggatgacaacgaggcacatgcctgggagtgagatgaggctgtagtgctcttgagctcctagtcagacaggcctggggttgaaactcggtggtgacacctactagctatgtgaccttgggcaagccatttcaactctatgagccttggttttctcctttgtttcgttgttgttgttgttttgttttgtttttgttttttgttttgaggcagaatctcactctgtcacccaggctggagtgcagtgccattatctcagctcactgcaacctccgcctcctgggttcaagcgattctcctgcctcagcctccctagtagctgggattacaggcacacaccaccacacccaactaatttttgtatttttagtagagatggggtcttaccatgttggtcaggctggtctcgaactcctgacctcaaatgatccacccacctcagcctcccaaagtgctgggattacaggagtgagccaccacacccggccagttttctcctttgtaaaatggaatatgaatacctgcgtggcaggggtgtcatgagagcccagtgaaataatgaacacaaaacggttagcacgtgactgacatttcatgaaagcatcaccaaattgccataatcattgtcacgaaacagatcaaacagaaaacctctgccatttttctaaccatagcagtgacaggggaatgtactttttgctcagacctgacagtgcctggcttgtcaggataattcaggatcctccaagacccagctctgggtggttcatgactagtcagttgcagtttgacaattttgtattgaggacctgagtcatagaggtccagggctgatgagacggttgttctctgtggcccaagacagggccatgggagaccttggccttagggttgcagaggaaaagcctccaacttcagcctttctctcaggtgtcctcatcagaacaattctcagtggcagaattttcaggacatcagccttgtccaaaatgcaagttccaaggtgatggaggatgtgagtccagacatccctcaaccagcaatggcagagcagatgggtgttccacacaggcaagggggctcaactgaagacctctggggccagatatatcccattgtcccctttgagctccctgccagttctgctcaggaccactccaggtcttaagtacgtagcagcttcttggggtcctttaattcccctctcaagtccaggccaatcttccaacttttggtgcaggaaggactctgtaagctctggtttcgattgggtaaatttacacctgtatcctatgggtccttgtaagtctctagtttgagattccatatttgcttccaataccagaggtgtcaattaaccctgagcattcatctccaacccagaaggactgaagacagcatgaccagtccatggcattctgtcctcctgtgtccaggggagacgtcactaagtaatcatgatattccctcccactaaggatacactcatcatcagaatccagggctcctgcgagccactgccaaatgattgggaaccctatttgcatttgagcaaatgttttggggcccagatgatagcaatggtgttggtaatggtggtgacagtaatgatggtgacagtgatgatgatcctatttgcagatgaactttgtggtttgaggcttgcaaagtcctgtcagctatatggctccacaactcattcctacaactgtcaaagacaggtaattgtattattcagtattcaggcctctttaggttttaagtaacagagtattttttatctcaatcatgtctacacctgggtcacctctcagggtggggtgggggagggggcagatgattctccaaaataatggattctaggggtacaaaaagcacaaatccacaagagtataattgcccccacctcaccattttatagaagagaaaagtggttgttcagagatgccaggtgccctgcccaaagtcacacagccagtgagtggaaaagccaggactaatacccagggttctgaagctttgagttcaggatgcttttctcatccctagcactgcttctcagaggctaaagcaaagttaccctcgctacctccaagacagcccccacagcagagcattctgagggcgtctttagtaacactggtgaggacctcgatgtggacagatggggcttctactgctgccagttccgtcccaaactggcctgggtacagattcagaggggacagtgggggcagggcaagcagggactctcctctcccagtcatcagccggcccaggcccaggcgcaagctgtcctgcgtcctcccagctaggcaacagcaggagtccaaacaggcaattaattactgcctggctgctgccggctctcctcctcccttgctcagccaagtgtgtaatgaaatggaaccaaaacagactcccctgcccagagggaccctggcatgcccaacagaggatgagctccagggaagcagggaaggggcctgagacgcagaggtgagtttattaacacaatgagcttccctgaacccttctccctcacctttccctgcctgttggctgcaaaagcagtctttacagacagcactgtgatcccaagtgatccctccctggcagcctgagtatagtggtattgttggtattaatcttataatattaataacagtgaagtaggcagtgtcctacatactgtacaggcattacctctttcttttttttttttttgaaatggagtcttgctctgttgcccaggctggagtgcagtggtgcgatctcggctcactgcaacctccgcctcccaggttcaagcaattttcctgcctcagcctcctgtgtagctgggattataggcgcacaccaccatacctggctaatttttgtatttttagtacacatggggtttcaccatattggccaagctggtcttgaactcctgaccttgtgatccgcccaccttggcctttcaaagtgctgagattacaggcatgagccaccacgcccggccggcattatctcttcaaatcctcaaatcaggctttgatgtactttttatgcctatgttaccaatgagaaaggcggagacacagagaggtggaatgggccctaagggggtgatgtaatgtagtggtcagagcacaggctctggaaccagatagaaccatttaggtcacttactagccatttggcctaggcaagttacttaacttccctgtgactcagtttcctcctctgcaaagtggtgctgacggttgtatctaccttgtaaggtcactaggacagtgtttgacgtgaagcccgatccatggtagctctgtggcttcagagggtaggtgctgttatccttgttctactattttacattaaaatagtaaatgattcagtgcataaagtacaccctatgcacatgacaaacatcacaagtgactaagaaacttttcatccacaaaatttcaggcccattctgaatcctctcactctggcttctgcatgccttgccaggtagcaagttcagctgggcatcatcttctgttctttgtattaaggacgtaatgggagtttttgtttgttcctggaagagccatggacattctgatggtgaatattcttttataaaacttagacacacttccctgcaagagatccttaggtgttccccaacctagttccaaaaatcactgcccctagggccgggcggggtggctcacccctgtaatcccagcactttgggaggctgaggcgggtgagaaaccaggagtttgagaccagcctggccaacatggggaaatcctgcctctactaaaaatacaaaaattagccggatgtggtggtaggcacctgtaatcccagctactcgggagactgaagcaagagaattgcttgaacctgggaggcagaggttgcagtgagctgagatcgtgccactgcactccagcctgggtgacagagtaagactctgtctctaaatataaaataaaataaaatagaatagaatagaatagaatagaatagaatagaatagaatagaatagaatagaatagaatagaatagaataaaataaataaaataaaaaaaatcactgccccagactgggggaaattgatcctccctagacatccagatgggcaggctggccagtgtggggccaaaaggaagaaaaaaaatccaactgagactaacggcatcgaaaaggcaaggtacagacctaaaatgagtcaggaactgccccctcactcattcatgccccctgtctccccacagcctctgagccctggggaaggggtagctgggttaatttatttctgtagcaccagcacctggcaaagggcccagcacaaagcaggagattggtgaatgctgaataaaggaaccagcaaatgaatgaatgaatggcatagctatttggggaaagatatagagtataaagctatagagaaaagaagaaaggagaaatacagtgctgtccattctcagctccttacaagtgctgaataatctctacattctgctgtgaaagatctagaaagacatattgctaagtgaaaaaaagagctaagtatacaacagggtgtggaatcctttatctttgtgttaaaaaacagaacaataagaatatacatgtgtatttgcttatatattaatagttgtacttgtggtataggcagataagaggcaacttaagaaaccagtcactggcctgtaatcccagcactttgggaggctgagatgggtggaccacctgaggtcaggagttcaagaccagcctggccaacatgatgaaaccccatctctactaaaaatacaaaaaattagccaggcatggtggaatgcagctgtaatctcagctactcaggaggctgaggcaggagaatccttgaacccaggagacagaggttgcagtgagccaagatcatgcactgcactccagcctgggtgacaagagcgaaactccgtctcaacaataacaacaacaacaacaaaaaccagtcactgtgttagggacagtcagaacatggggggatgggaaagaggagttacagggagacttcaccctatatgccctttatatattttgtaaatttctaaatcatgtgaagttaaaaaataaatcaagaaaaggaaaacaaaaaaatagaaaatttctgctccaagaaaatgttgagtaagatctacctggcttaatggctgaggagggaagggagcgtgcagtgaatacctagttacagcccatcttctcaaggagtcagtataattaagggcttggagttctccaacctattgatcttggaccagaaaacattagatgaattcccaggggcctcgagctttccgaagttgtttctctaaattccacatctctcttgttgatagccggtagcctctgaacgctcccacgatggctgaggggtacagttggtgtgggctattgggactagagacgttaggaaagacctcatagaggggctggagactaccctggggtggaaggggaagagaagcctaaaggcctggatacaaaaggcaaaggaggcaacaaaaacaacaacaacaaacaaacaaaaaaaaaaagaaagaaagaaaagaaaaagcaatattgtccctgctttctccttgtcatctctccctaagacccacctcctgagaaacatcacaatatccaatatcttgtagagagacttctataagccatgacattggggaaggcgtaatcactctgacatcaggattacatttgtaattgacaaatgtgggctgggtgcggtggctcacgcctgtaatcccagcactttgggaggccaaggctggcggatcacttgaggtcaagagttcgagaccagcctggccaacatggtaaaaccccgtctctagtaaaaaactacaaaaaaaaaaaaaaaaaaaaaaaaaaaaaattagctgggcgtagtggtgcatgcctataatcccagctacttgggaggctgaggcaggagaatcacttgaacctgggaagtggaggttgcagtgagcccacataatgccactgcactccagcctgggtgacagagcaagactccatctcaaaaataaataaataaagacagacaaatgcggaaatagcacagatgctttcagggagcagtggacgctgagagccccagcacaatgggctgggaggaccggggtagggggaagtctacagaactgcacctagggtcagagttgattctggagccaaaggaaggagccagcagctggatgtggctggcccaactctgaggggcttgggtgctgtccaggcacaagaatatctccttgtctttgggatctagactcagagatcccacagtaggaggcctgtgtcctgtagagggacatcctctataggaagtctttgatgagcacattcatttggcttttacacctgaaaggcctcctaaccttttgatgaccttcgtgttgatagacaaagcagcccaggctgtgagtccccaagaagaaaaccccagccctggtctgcagctgcaaggatcaagggcagagggaggtctccagcaggctgtacaaagctcaaataattttgagcactgccctggagcctggtgacaggctggtccaggccatggcctcctgtgccatcaaatgcccttttcttaacaaggtttcctcatgctaggaacagacacttttctttggcctgacctctctcaggggctcctgccttgcgtacccacctgtgagtaccaccatccttttaggctgaatatggtcaatgttgataataataagtataccaacagcaataacaatgttatcaaaattgccatttactgtgtttactaaaaggcataggactttacccacattatctcatttaatcctcacaacaaccctatgaggaatgtactattattgacccattttatagactgagaaaagggcacagagaggtaaaataacttctcctgggtctcacagccagcagaggtagtgctgggattcaaatcaaagcagtctgaccctaggatgggttccattaatggcgatgtgacaccaagctcttgttggctttcttccccagtcggcctttcctcccaaactccctgcatcagatgtggcttctctgggatccctgtcattggctgtggaacctcagaatcacctctgatacgtagtttggctttggtgacagacagatatgggtttgagtcttgactctggctcttgttgctgtgtggcctggaggaaggtgatcctgctctctgtttcttggtctccaggtgtgtgaaatgatctggcaatatctggtgggcttctgtcattgtctgtccagtgcctgtgcttactctgagaactctcttctcatccccatccacagggccatcattgggttgccacagtcttatatgacattgacactgacattgactctgactataagactgtggcaacccagcaattgcatggttttttgtttttgttcttgagatggagtctcactctattgcccaggctggagcacagtggcgcaatctcagctcactgcaacctccatcccctaggttcaagcaattctcctgcctcagcctcctgagtagctgggattacaggcatgtgccagcatacccagctaattttttgtgtttttagtagagatggggtttcaccatattggccaggctggtctcgaactcctgacctcaggtgatccacccaccttagcctcccaaggtgctgggattacaggtgtgagccaccacgcccagccaatgattccatatttattggagttggtcggtgggtgggggtgcggtgcttgatttgagctggccacagtccttccccaggacttttcaagccaagcttatgacaaacagctagttccactccagcagtaataactatgagatgggaagcttggaagcggttagcatcatgtttacttcaatatggaagaagttcacagcagaagaaaagatgacatgctgagagcacagaaatgagaagagaggggtctctggtcctggctgtcctgaggccatgctcctgaggtctgcccctcccataattacctgagaccacagcattcttccagtaatgccctgttgaacctaagctgaggttgagaatacatgaggggcacttagcacattagatggaaaaagtaagccctcaataagtggtaactattatgactatttttttttttgaggcagtgtctctctgttgcccaggctagagtgcagtggtgctatctcagctcactgcagcctccacctcccgggttcaagcgattctcctgtctcagcctcccacgtagctaggactacaggcgcccgccaccatgcctgactaattttgtattttcagtagagacagggtttcgccatgttggccaggctggtctcaagctcctgacctcaggtgatccacccgcctcggcctcccaaagtgctgggattacaggcatgagccaccgtgcctggcctatgatgactattattaagacagcacaagcctgggcaacatggcgagacacccacctccacaaaaaatgttttaaaaattagccaggtgtggggcggacgcctgtggtctcagctatttgagaggttgaggtgagaggatcgcttgagcccgggaggttgaagctgcagtgattgtgattgtgccactgcactccagcctaggtgacagagcgagaccctgtctcaaaagaacagaagagcacagactcagctcaaattcacacctttagaggcagtcgatggaaggagagaaggttaaattctattttctgtatacaccactgtgagctgtggggagtccaggaagcctcctcgggaggagcttgagaggagggtggaagacatcttggcaggggctggaatgaggagacaggtcttgctgaagcaaagagctggacagtttgaggactcagccccgcctcccctggtcaaggcccttagaggcatctctatctgttccttgctgtcagcacagtggtttgtccacaggcctgtggacagcctcctttatagaagcctcttgctgagcaccaggatagaaggatgagaaagacgtcagccatacccgcatggatgtgcaacatgccagggcaaagcacagagggtggcaggaagacttaggaggggcatacccaaaacttggggaatcgaagagggctttctggagggaatgacatctaagcagtgacctaggaatgaatgatgatactagctaatatccatgaaggacagattgcatgtgaggtgttttagatgtattatcaccttgaatgtaatactctccgccaccttgagagggaggactgattatgcccactgagcagattaggtaactgaggctctgctaggtgaagtgtttcctggtcacacagctacaaagcggtggagcttagatttgagttcagctctgtctactataaagtgtgttctggggccgggcgtggtggctcgtgcctgtaatcccagcactttgggaggccgaggcgggcagatcacgaggtcaggatatcgagaccatcctggctaacatggtgaaaccccgtctctactaaaaatacaaaaaaattagccgggtgtggtggcgggcgcctgtagtcccagctacttgggaggctgagacaggagaatggcgtgaaccaggaagcagtgagctgagatcatgccactgcactccagcctgggtgacagagcaagactccgtctcaaaataaataaataaataaataaataaataaataaataaataaataaagtgtgttctgaaccacagaaatgagagtaaatgagagtcagggtgggaagcagatcaacccctgcagctggaactaaggagatctagttgagttgctggataggaggctactgaagcaggcaggggctgggacacatgaggccttgcaggctgagggtggggggagtttgtgcttcatcttgggagcagctggatgacggaaaaggccagggctggctctagaactctacaaggtaagcatcctgcccacagatgcagactgaaatgctagtgcatgagcctgtggcccatccgccctgggtgacaggctgcctcctgtgtctcacctgcctgttgcagcccccctcttgtccaggcactggagagaaggagcccaaggactcaggccctcttcatctggagcgaggagcaagctgaggattctcagccaatcaccaagctgtccctaaatgagccataatcacccctgattgctcctttgtcaggccggctctcagagccacttccatctgaggctgtggggaggggcccttcagaccaacgtgcactgctggtttcctattttagaataaacatgtggggggcggggggctgggcacctcctgagctctcagagatccaaaaggcaggcacagatgaatgtgggggtgaacagaaccagtccccacagtgggcaggagtttacagctggtgagccacttctctggcccttggggccagatcatatccctatttgatgaatgaataacaggctcagagagggattagtgtattcgatcacagagtgcagacaatggagccaaaggacctttcattcattcattcactcgccaaatatgtattgagcacctgctatgtgtcaggcactgtgctgggtgttcaatataaacccagaccttttccgatcatgacaacaataacaatagccagaggttattgagcacttactaagtgccaggtgcttcactacctacattccatgtgatgtctcgtcagtcctcccaccagcactgtgaagtggagtgatgcaggcatgccaatggggcaggaagggtttctctctgtctccatcccaaaggttggcatatgccaaaggtgactcacaaacagtggcatttgaaggagacaggaactgaagagctgaggggatgagagaaggggtccaaagaggaggggtggcttcaaggtggtgaccacatggtgactgcaggggatcagatcaaagaactcacgctgcagagggcaggaagcccagggagctgattaggtacagccacagattgcactgtattgagagatcctgcttaacgcgagtaaaaccctcctctatgccttcctttgaatgctgtgtgcagctcccagctctgaccagtttaacaatgaatgacccatcccttcttccccccgctggggcacagttctagggtgatcatttttatccccatttaatagatgagtaaactgaagcagagaggccgtgagtcacctgccaagggtcactcaaccagcaatggcagagttgattccagagctgaaccctgaagcaacgtccgcctcaggctggtcctagacccagtggtcatgagtctagcctggggacccctcggtacttggcaggcagtggataaaacaacctcagcccctcactaagaaacagcaagcccctccccctcctgcatctcaccctccccacggcccagctcctctcagagctattaaccaggtcacgctggcttgtcccagtccaatagttcccttaattgcctttttatagcacgtcgtacaactgttcattacgctgtcatatttcccctcgaaggcagcagtgggggagccaaactgaggacggggacccatccaggtggcaggggctgtgtgtggggcaccaatgtgtgaagcttattttctacttggtcagaatgaattaaatgcatgcttctcacccttgagtaatacaggaaccacgtttaaaggggaaaaaagtcacagccccctgtcaacaattgacaaattatctttattacaattttatgaaaatatgtacagacagaaagctagctctacacaattggaaaagcggagacaatataccattgcaacaaaaacaaagcctcaatatcagacatttcaaaagaacacgaataatttaacgtgatggatagtgtgtaggtgaaatgaaatcgcacttgcacagtgaatatggttcagcatttagcccccctctgttcttttgtcataaggcccataacaattaaagcagtatttggtcatccaggagacctagaatccgctggtaggttttttagatataaaataatataatataaaattggccaggcgcggtggctcacgcctgtaatcccagcactttgggaggctgaggcgggtggatcactgcaggtcaggagtttgagaccagcctggccaatatggtgaaactcctctctactaaaaatacaaaaattagctgagtgtggcagtgggtgcctgcaatcccagctactcaggaggctgaggcaggagaatcacttgaagccaggaagtggaggttacagtgagccgagatcgcaccactgcactccagcctgggcaacagagtgactccgtctcaaaataaataaataaataaatataaaataatataatataaaattaaccaattctgagagagagctctcacagcctaggttgagaaacaataaatgtgtcccgggagcctcttttttgagatgtagtcttgctctgttgcccaggctggagtgcagtgatgcaatctcggctcactgcaaagtccacctcccgggttcaagtgattcttatgcctcagcctcctgagtagctgggactataggcacacaccaccaatttttgtatttttagtagagacgggctttcgccacgttggccaggctggtctcaaactcctaacctcaggtgatctgcctgccttggcctcccaaagtgctggaattataggtgtgacccactgcaccagaccaagcctttatcagctgtgcaggtctaagacatcctatggggaagagccatgtgttcttggggctggaaagccaggatacagggcccagaccactgaggccagatctcacccagactttaatgaaatccacaaggtcttccgagagcacctactatgtacctggccctatgcctcccacctccctgtcccaggagttgcctcagtagtcaagagggagacaggggtgcctcagaatagatgtatataccagtcagtgcagggagcattcttgggaactgacacaaagaggtgtttggccacggggagtcagatctggattgcagtgcttctctggagcccagagacccaagccctgccctgcagactcacctagagtgctgaggttataaggacagctctgatcctgggttcgactcctgaatccgccactacctagctgtgagaccatgggcaagtcacttaacctctttacattccagggtcctcacctataaactaaacataaaaccaacccatgctcatggagatagtgagaggcttgtccatgatgttgtgacacagggaaaggaagcacttagcttagaacctagcagagaataagcatttggtaaatgttagtgttgatatctttcccgattccagctctcaacagaatttgaagagaacaaaaatgtctagattgggcttttaggctggaggccatggactcaccatgggtgggcttagggatatgaaaccttgtgcaatattgtgtgtgtgtttctagaagaaggatctgcagcctcaccagatgtccacgggggctgtgacctagaaaaatctttggtcgctgagctaggtcagggctggcagaaccactcagtcttagctcaggctgccatgataaagtgacaaagcctgagtggcttcagcaacagaaacacatcttctaacagttctggaggctggaagtcccagatcatggtccagcaggattggtttctggggagggcttgcttcctagcttgtagacagctgccttctccttgtgtcctcatgtggcagagagagagagagaatgagagtgaaagagagacacagagagagagagagtgaagagagagagaaatcaagagagaggacactctagtgtctcttcttataaggacactgatcctatcagattggcatcccaccatttttacctcatttaactttaatcacttctatagaggcatctccaaatacagtcacattgagggggagggcttcaacatatggatttgggggtcataattcagtccatagcagtcagtgagatagattattctagatctcggtggaggcaggttttgaccagcaaaggctgacccttgaggcttctaactaaagcaaggaccacctgcagctcccctggccccagtgatcatcactcctcccaaccgtcctcttccctgcttatgcccatccaattatccacttctccaagtccattcctgcaggccctgcctgcagcctcctaagatgacagtgggctagtctcaggattgtgagaatttaaggaaacaatcctgagagtgtactttcagcagtgcctggcacacagagagcactcagtaaaggcgagctctgcacctagagagtgtaggaggtcagacacacagcccgtttgcactgctggagcccaggatccctgtcccagggtttgctggaatcagagcccccaacacagctgtctctcccagttataaccagtgacccacagattcctagagacctagaatctgctggtagtttctgagtgttcttgcaaggaatccctgaatctggatgtgcatcccaaggcttagattaacaaaaatcacatctcacacacctatgtaggactgactttcaattacataaaagatgatgtgagcacaaaagacaaatccattcagaagagctacagtattcataattcagacctggattttggctgttgtgtgtttcttcagaggggggaaatggctttgtaacattgacttaattcatctccatgaatgagcatctaatgtgtgctgggaacacagtggggaatacggctgacatgcccctgcttcccagcataactgaagctgtgttctcaggaaagggcaggaaccattggtctaacccaccaagtcaggtccagggcccctccttcagttctaggtagcttctggttttaaaggctgctgagggcaagacctgggtcctcatgtctcccgctctctgaccccttctcagagctgtcagcccagaaagcatgaaccttgaaccccagaagtcatgaaatgcagcctcccataccctgaggcaggacttctctagaccttgtctctgataggacatccagcctctgcctggacacctctggagatgggatgctcattatgtgtgcaaggaaaactgctactacatacacagtcatgaatgtattttaatatgtcttaccctgagctcacaggggcagcacctacatggtcaatggccccacctgatttgtcccattgaagggagaagaatcagggtctttgttccatgcataggctcccacctggctcctcagccttgctgcgcctctcctcccttgtgcccagggacacagcatcaggaaattgggttttgatttggggaaaggtgaacatggctccctccagctataggaaaacctcaccaatgtcccagccccaggatacttgggggtgggagtggtttatgaagccagtgcctgtcccctcagcaggaaaagacttgcaaggctgactttgctctggaaaaggagggctctgagctacaggggagggggagggggctatctgtgatcattcagccccgaaatgatgctcatgatgttggctttccaggccattaattcaagggctccatgcctccccttcccccatggtgctgtctgctctgggagataagcccagttctatttaaccctatttattcccccaaagtgactcccatctctgttagccaggcatttaaccccctgggtactgaaggcatcaaaggcagagagattgagctcatgtgtcaggaaggggtgcgtgcatttcacctgggccctggcttcagggaatccgatccaggtccttcctaatccaaactcctcatctggaagtccttgcttcacaaggcttggtggaagtcctgagagaaggtaggaacctgtgtggccctggcaggagagaccctctgacacccccaggttgggtagcgacagctcctgctctctccccacataccctcccagtccctagtttcttagtcacaagatctgggttctggcatcagcaaaagagaaaggctgtggcatctctgcctcttttgtgtcccactggctggtggctgcattcagcaagccctcttccatctccatctccctgcttggtcctttttacgtcccctgcccctttctgccctttgttctctcctcttttccccttcagtgatcacacaagagtagtcctgactactcgtctcggtgtgtgtgtgtgtgtgtgtgtgtgtgtgtgtgtgatttcttgtgtctgggggcttgtcagtgtgtgtgtgtgtttacctgttcttgcactgctgtgtgtctgagcctgttatccaggtgcctctgcccatgcagagggacccaccagtgtctgtcctgatttctttgtgtggcaggcagtcttagtacaaatcttgcatgtgtctgtctgtgtgctggcctgttcatgacctgtgtgttgctctgtcaatgtattagaatgctctgttcaatctactagaatctctatgttgtcctcatgtttttgtacatctatccatcggcttgtcatgctctgtgtgaatgtatgtgtgtgttgtgcttcaactcaggggaccagtctactgcaaaatcctctcctagggaacccttccagaggagctatttgggagaatttggaggttgatggcttcgccagggcagagcccagctcactaccagcaagggaagtcatcctgttggtctcctgggctcttccctctccctgctcctgacctccctccccttctctccaggtcagcttgcgactgtgaggagcagggacagagagcttcaaagacagaagagcgtacattccaactcactcaacccccagatccaatcgcaggctttttcttgtgcactcccatttccacccccagccccacaacgagaactggctgttgagtatagtcactacaacaatcacaaaataattgctatcacgtattgggcatgcagcacctgttaagcatttcatatatgagatctcattgaattttctcaataattctatgaggccgttattcttattttcacattttagagatgaggaaatggaagctaggagaagtcaaggaagtagtcaatgtcatagaattagtatgtgatggggtagaattattcaataaagtgtgggttgtttgagagtttgccacacctgccttcagcctgggaagaggcatttattacaaacagcaggaaaggagggaaatatgggaattcctttcccaactgctggcatctaattatagccagcgggactagaatctgattttgaatttcatctctttggacaatgaggtggccaaataccaaacgacaaccagggagaaatgatgtaaggacaagacgaggtagtgcagggcaaggcatgctggaaagagccttaggattcctgggggttctagcctggctttaacctggattctgtgtgaccttgggcaggacacttccttgctcaggcctgagttttcttgtctgtaaaactaggataaatgtgaggttctgttgggatgtttgggggaggtttaaacattgcagaaaggaaaattggactcagggctttctaagttccctcctagacccaagaattggagtggggagtataggaagagactatgcttgtgtcatcttgacaattcctggaatagccagaacagaatcacgtgcacaggaagggctgtgaaaaggttcactgaatgaaggaataaatgaccccatctctcactgatgaaaaaacgtcacagcccactttagactcacttgtcagagaaggcatcagtggccatcctaaggtctgggtgtaatgctgtggaggaggcactggggaatcctacaaagacccagcctctgcccagatcatctcctgtgggccaaagaatttcaccagaaacagaaggggagaggatggcaattaggatgtggagatctttgtctataggaatctgtagggaaaattctctctctctgtctttcctgtatctgagaattggggtgggccgaggctctccgtatagggcaaatttcggatgggggatcgcttctatttagaagcctccttggaggagaggatctctgtgtttggaggaagaatctctttcctgtctttgttctgggtcctgtcatgacttggagtgtctgtatttggaggacggttctatagaggggtctttttttgttttgttttttgttttgctttgttttgttttgttttttggtcttagtagctggaggctaagaagaggatttctgtcttggtttccaccaggcaggagctaggggctttccagagcttctggggaaattaagggggtacctggggagaggttaggagcatctctgtccaatgtggtggaggttccctatctggagagaagcctcctccgggagactgggaggggcttgggatgggaggaggtggcaggaggcgggagggtgtagagagggaagcctgtcttgtcctggcagctccaactctctggccaaagccctcgggccgccctacttgtgcgctgacgtgagctaatctagaaatactgcagagaaagagtggctggggttcccagggagaaagggcctcgagagaggggagatggggagctgcttccttttttgtttccttcggtttttccgtccgcccccgcccccacttccagtcacagccgctacttctccattcaggctgggactgccaggtggagccctgcggtttactgctcaggaggagcccggccaggacatcagctggggacttacgcagggacccattcagagcagcggaccctcacggagactactacaaagggactaacacaggcacgaacgcaggcaaccccattcgggaacacatacgtaatccaacacactagctctggcacacacactggaatgcgcgcaaaaccacacagacacagaacacacgcggttaccaaacctcattctcagaggccacactgatccaacctcaagcagagtctgatacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggccgggtttacgcgcgaaggatgggtgccagggaaactgacttatagacgacccgctccgcgagagactgacaactcagtcctgcgggctttcggggcgcccagaccagtccttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccaggtaagcgcgggattcccagttctgcctgtcctcccccctcccagctcagcgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaaagaagaaggggaaatcgctgaggtcggagtctcctccccccgcacacacgcatagacacgcacacgtatataggcaggcacaccacatgcccacagccccccttcccacgaacaaaggcgcaggcacaggcgcacacgacatgtatctatatatagaccacagtactatccccaaatgcacctgcgtacacccctacagctccacaaacaaaagcatatacctgcacataccaaacacacgaatattcgtttgaacatatgcacacacacatgcacagatgcatgcagacaggaaccagcctgctcccttgggtgcggccctgttggagacatacaggtatacacacacgaaagcacacacatgctcccacacaaacacatttagtccgcaataatccagcattacctgtgcacagactcgcccctctcgcccgaaatcccggctgcaccgcaaagaggcggccagctcctccccgtgtgaccctggcgaagccctctccagaggctaagaatggcccctgctctctaggccctctccccttattcctaaccccccactccccaccaggcggcgcaggactcctacatagggagcaggtttggagtcttggcaacgacctccgagctagcaggggctggcaggccgcagctttctgggccgaaggagacttcagctctaggcaaccccggtcccttacagcttggccccgcggcgtccctggagcgcactatcactggggccacggaaggcaggttttctgggagcagaggcctcccaggggttgttccatgtatcggggtaagcaggactccaccgggccccgaacaccagatggcccgacccaaggcgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaagcttctggttctagactcttgctcggttcggctttctggcctccctggcgccttcccgccaagctcctcctcctgcttgcctccccagcctccacttagtccccttccttaggtctcgccctcgcctcactctaactccagccttgtcctaagactctcaatttccagccctgcttcctcctccccgcgcgctgctccccaagcgtcttcacattgtctctgttcttgcctcccaggggctttgccccaccttcagcccctctccctctctaccctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatccgttgccaagttcgctgagcgtccgcgtctggttgcctctccgccccacagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctcaggtgtgaggaggaagctgaagacggagagtgctgtagcggccccctcagctgccaggtcgaggtttgttcgaatctctcccctgggggcgggtccatctgagaatttggtggaagctctcaacttccaacctcaaaacagagagggacagggggagcttttatgtaccagaactttataaatttgttcaacaaatatttataaacagccaatcagggctggggcagtgttggaaacctggggaaagaaactcagccttgccttccgggagcttacagtctagtgaggtggagacaggcaataaacaaggacaggcaggaatccacaacgtgacttcagattgtgaagagggctacaaaggaagtcagaagtgggctgtgcctttcaccaggtccccagagccacgagccaatctggcccggcaggaggcatctgccacccaggagaaccctgccgtgcaatccaaggtggggtttgcacagccatagcaaagagatctgactctagaatcaacagcctcaagttgtagggtcccagtctccccctatcttgcgcagcctgtctgataaagtgtttgcctgaattacccgaaagatctagtcttttttgtgctgatcccactccaggcgcagcacctgcactgactccaggagggccagtccagggactgttgggaaaggtcagagtcagactttctgggtgggagctgggagtgcaagtccgctgggtgggttccagggtccgctgtcaccacggaggcagaggcttcgttaggaacgacttctccaggtgcgaatggtgcacgggaaagaagccagggagaatgcctaagtagggtgtgtgttgctccccgcccgcttgcaaggggcatgtgagaggctaggtgaagatatgcgtgtggggtggggcaggctgcatcgtgtgttgtgagaaccttggtaagtgtgtgtgcgtgtgtgcgtgtgtgccgagcatccgggtgggcgtgctccctaaagcgcctgcgacagaggtgacctcgcatcaccctggttctgcggccacagacctggagtgggaagggaggagggataggacccggtgtcctcagccatcactgtggctctaatgctttaaaacgggccatctgagaagtccgctaccttcggcctaattccccggggtcactattgtcgcgtgttcaggatccggcactggctgaagggtcctcagtttctcgtcttcccatgaccactgacgtctcccaggcctggggccgaggggtggggtggggagctgattgttcttcccccgccccaactcccaaggtttctcagcgggtccacggaccctggggtgctctccgagtcagtgtgtcgccttcagaaaaatcccggacttctatggtggaagggaaggtgggagcgtcacgctgcaccatctctgtccttcccgtctttaaaaggtcgaaggagacactaggcaggctccggatagcggcgccaactctgcgggctcgcctggatccgctccactaatcctggctccaggttttgtgctcagcttgcagcgtctcttgtcctagggggcgaatcctgagggtggcaggggcgggagaactagcaccctagacgcccaagggaaacccgaaaccctggtcggtaggacaccgatacccggactcgcatccaggctactgagagaaataaggaggaggagtggatggcacccgtctctgcacctctcatctcccccacccatctacccccacctccaccatcactaaagcgtaaaggtagatgttgaaaggaagaagtcccagctttcctcgcagtgggctcgctgtgcaagtccaagagagcagatagttctggcaaggctcattctgggatcggattgagaaggagaggaggaatccgcgtcagccccacagggctcacatcagttcttatggggcaccctagctggacgtgctgcagaccctgtaagctgtccccacctgggtccgcagcataagtgtgtaggtgtacctggccccttgccttggggccaggacctggaaccaccaagacccacgtgcgccggcggaacccaggatcgcgatcgcacggtcccaagaccgccctgcctcgccccctagcggtgagagcgcaaactgccggcccgcaaggacggttctccaccctagtcctaaatgcttcttgtctccccctaccccacctcctgcttagttgataagcattgcttctttctagtgctttatttcaggtcctcaacattacaaaagtttttagtcatttttccccaaacatggatggatgcttattattgaacatgttttgttatatgacaccgtcttatcccagggactgagtgttcctcacttaaagacctggtagggagggagccaaacaggctccatgggggccatccaggaagtggagaggatccaggccttgctattctagaggggacttcagggacaagagccagagagaggctttggtcaaggagggggcaggtccctaggtgggctccatcctcaccatgagtgagggtgtggtagggtactcagtcctggacagccaaggattcattcgttgcacttgtttgacctcagagagccagccttgggtgtccttctcatagctctttcgttttttccttttcaagattatgaagaatttctaatgtatagaaaaggtgaaagaattccacactgaacatacatacacccacacccaccgccgcctagactggatgattaacagtttaaaacactgtatctaccccatacctatccatctatccatccaacagtctacctgtaaaaaaaaaacaacattcaaaagttgcagacatcagtatatttccctcccaaataattattatcatttttgagacagggtctcggtctgtcacccaggctggagtgcagtggtgagaacacagctcactgcaaccttgacctcctgggctcaagtgatcctcccacctcagccccccgagcaactgacaccacaggcaaggcatgtgctaccattttcagctaatttttaaattttttgtagagacagagtctcatcatgttccccaggctggtctcaaactctgggctcaagcaatccccctgccttagcctcccaaagtgctgggattataggcatgaacccctgtgcccagccacccctcccaaatttttaagctttcaggacaagtaacagtgacattcagatagcacagcatcagtacagcactaatctgagccacactggagaccaaggcaaaaaaagcaatatccatcctttctttacctcagatattgttattttgcttacattattttgaacgttatggttcacttttgcattaattttgatttttaaaaaatattgcattaaaattttatttatattgctttctggattttttgcaccctcttaaattttgctaccaaaggaaatgcctcacttgcctcatgctaatcctggtcctggatgtgaggccaggcctgggagatgagctctgcccccccgggagatttggattgagatttttcaagagtctgactatagctggttccacagtgatgctttgggcaccatctctgccagttgtggagtccaggaaggcacagtgagagcagagcctctgaccagggacacccagcagcatggtccagcagagtcacatagcgggtggggtggagggagctttacgattccagaagcttccagcaaccctcttgggggtgggatggaaacagggtgaaaaggctgaggatgctatagaggggttggtggtgtctagaagggaaggcggtgcagctagaagggagagcacaattaaaggaattgttagtgtgattcagttcctgtttcaaggtctggtagttaaacaagatttatttatcaaatatttgttaagcacccactctaggccacacactaggctaaggtctaatgtgtgggaatgcaacaggaaacaagacagacatggcctctctggtagttgtcagtgcccaccctatgttccctagatgcacctaagtttacctgaagctgtggaacatgaaccactgccagtgcctccatctctcctcatctccctgagggctttctaggctaccttgggagcatgacttggaattgtcgggcagctaacagcccctagtgctcaatcaattggcaataaatgcctgtctcctgtcctgtgatgggaccattttaggtctattccacaaggtatcttggagggtccccagcaggattgaacctcaggtgtccacaagctcatcaaagcaatctttatttggcctttcccccttccttttcttcctttccctactttcaaggttcacctcccacataaattgactgcatctgaatctttgtcttagggtctacttttagggaaaggtaaatgaagatcctatattcacagtgcttctaatgtaatatagtggtccccaaatatctttccataggcaggtgccaggctgggtgaatcagaataaaatggggagctttctagaaattcctgctccccacaaaacccctagattcagattcagaaagacctttctcctccttctcttcctcctcctcaaccccctcctcctcttcttcctccttctttcaagttcccaacgtgccactggcttgggaccactaatattgagaaggtttggtcaatgggagggtggtggatggatggatgaatagatggatggattagtaaatgctttgaggtcaagggttggatggttgagccaatgaatagatgaatcagtgagtgaaggaaaaaaatggattatagatgaatggtggaccaataaatggtccatggatgaaaggaagaaaagaaggaaacataaacaggtccatagcaacaaactttagtaaactccacaagggcagagatattctctgtttggcaccctactggatctccactatctaacacagacctgatatacagaatgttcttaataaattatgttcaaataaataatgtattttcagaaaactatcgacacattaatagtactaaagtcacagaaactatgaggtcaaccaggagagtgcatgaacatttaaaaagcaccgggccagtgaccttggataacagcaatatttaaaggtcaggcaggccagatgtggaggctcacgcctgtaatcccagcattttgggaggccaaggagagcggatcacctgaagtcatgagtttgagaccagcctggccaacatggtgtaaccccgtctctactaaaactacaaaaattagccgagcatggtggcgtgtacctgtagtcccagctactcgggaggctgaggcaggaaaatcgcttgaacccaggaggcggaagttgcagtgagccgagatcgcaccactgcattccagcctgggggacaagagtgagactatttctcaaaaaaaaaaaaaaaaaaaaagtcaagcaaatgaagagaaggaggaaaagaatgaggagtcaagattgataaaacatagtctgacagggaggagaagaatataaagagaatgatatcctggaattgaggaaggacaggttgcaagatggagaaaatgataagaatttatttattttctttctctggacacatatcatcttgatttgaggcaggcatggagatgtgatgatatagttcggatgtttgttccctctaaacctcatgttgaaatgtgattcccaatgttggaggtggggcctcgtgagaggtgattggatcatggggaaggatccctcatgaatggcttagcaccatctccttggtgataagtgagttctcactttgagttcacgtgagatctgactgttttgtttaaaagagcatggcaccccacccccatccctcgctcttgctctcaccatgtgaggtacttactcccgcttcgccttctgccatgattgaaaacttcctgaggccccatcagaagtggatgctggcactgtgcttcctgtacagcctgaagaactgtaagccaattaaatctcttttctttataaattacccagcctcaggtattcttttatagtaacacaaatggactaatacatgtgtgtactctttgtttctaaattttggagtagaagaaacacacctagaagcttctcaaagaagagtgagatcagacttggaaacaattgtcatggagcctttactctgaagaggtgttcaaagcgggagagttgaagaatacaagtaagtaaggccgaccaagagaagctgaagagagaggaagctgacgaacaaagatgaggactgaaaagaggctgccgtcggttagattcccccagcaacagacctatttgactgaagtagttcacatgagagctgataccaagaagtaccagtagcacagtggagaagtgagacggggaaggaaaggaagaatgtcaattcaggaaactttatgggtagggaagcacctgtcaataatgggagcttaatccatctgagacgtctgggaggtgagagtttgccactaacagcctctcattgaaataactatcaaagaatagacttcaggaagaaagaaacttaacccacaaggaaggactatgtaggaagcaaatctgtgcctgagcaagtactgcccatagaaaacaatattaacaataaccaattcttgggatctaaggtggaactaaaattttggtaaataacctctaagatgggagggaataattgaagtcttatcttctatggctttctaattcaaatatagggagaaataccattaactttaggcttaatgatgagcaagagtgttactcatacaccaccactatcacaaccatcaatgacaagaacgacaacaaatggatggagaacgtgtaacttccaacctagtagaaggaaaagagcaaataaagaaaacttgcacggatctgggtgcggtggctcatgcctataatcccagcactttgggaggccaaggtgggcggatcatgaggtcaggagttcgagaccagcttggccaacatggtgaaaccccgtctctactaaaaatacaaaaattagccaggtgtggggcatggtggctcacgcctgtaaccctagcactttgggaggccgaggcagacggatcacgaggtcatgagatcgagaccatcctggctaacatggtgaaaccccgtctgtactaaaaatacaaaaaattagccgggtgtggtggcgggcgcctgtagtcccagctactcatgaggctgaggcaggagaatgatgtgaaagtgggaggtggagcttgcatcgcgccactgcactctagcctgggtgacagagtgagactccatctcagagaaaaaaaaaagccaggtgtggtggcgcttgctggttgttccagctacttgggaggctgaggcagaagaatcgcttgaacctgggaggcagaggctgcagtaagccgagatcatgccactgcactccagtgtgggtgacagagcgagactccgtttcaaaaaagaaagaaagaaagagagagagagagagaaagagagaaaaagaaagaaagaaagaaagaaagaaagaaagaaagaaagaaagaagaaagaaaggaaggaaagaaagaaagacaagaaagaaagaaaacatgatcaatgtagaagtcagggaaaaagaaggaaatgaaagaaaaggaaaagaaagaaaaggagcaaaataaaggcccttccagtcaatacagggtagtaaaaataaatgaataagtaataaagataagtggactaaactagccagtcagaagacaatgattctcagattgaaatttgaaagtccatctatacactctttgcaaggtatatatctaaaacaaaagatggagaaagattaaaataaaaagatggaaacatttgccaggctaatactaatcaaaagaaagctgccagcggggcacagtggctcaagcctgtaatcctagcactttgggaggctgaggtgggcggatcacctaagctcgggagtttcagaccagcctgaccaacatagagaaaacccatctctactgaaaatacaaaattagcagggcgtggtggtgcatgcctgtaatcccagctactcaggaggctgaggccaaagaattgcttgaacccgggaggtggaggttgcagtgagccgagatcgcgccattgcactccagcctgggcaacaagagtgaaactccatctcagaacaaacaaacaaacaaacaaacaaaaaatgacaaaatatgccaggatgattattctaaacttggtgtttttaataacacaggttccaaatatagaatgtagagaaatggactaatttacaaacatagtaggagagtttacttattttttattaaaaacaatttttttgagatagtgtctcactctgttgcccccggtggaatgcagtagtgtgatcatagctcattgcagcctcaaattcctggactcaagtgatcctcctgcctcagtctcctgagtggctaggactgcaggtgtgcactgccatgtctggctactttttttatttttatttttgtggaaatggggtctcactatgttgcccaggctggtcttaaactcctggcctcaggctatccttgcacctcaacctcccaaagtatgggattacaggcatgagccaccatgcccaaccaaggagagtttaacatactttctctgatattcaaattaacttgcctttttttccttttgtttgcttttgtttaatatgcctttgcccatacttcaattttttattttttatttttatttattttttttatttttgagatgtagtcttgccctgtcacccaggctggagtgcagtgttacaatctcagctcactgcagcctccacctcccagattcaagctattctcctgcctcagcctcccaagtagctgggattacaggcatgtgccaaaacacccagctaatttttgtactttaaaagagacggggtttcaccatgttggccaggctgatcttgaactcctgacctcaggtgatcctccaatcttggattcccaaagtgctgggattacagccactgcacctggccatacttcaatattttaagttttattttttgtattacatatacacataatttaaagaatcaatgaattctacaagttaactaaaatagcactctgtagccccttcctccaatttctccttccccagaggcaactactttcaattcttacacttgatcccgttttatttttttttgagactgagtttcactcttgttgcccaggctggagtccaatggcgagatctcgactcatcacaacctccacctcctgggttcaagcgattctcctgcctcggcctcctgagtagctgggattacaggcatgtgccaccacgcccggctaattttgtatttttagtagagatgggattctccatgttggtcaggctgctctcaaactcctggcctcaggtgatccacccgccttggcctcccaaagcgctgggattacagatgtgagccaccgcacctggcacttgatccttttaatatttatctccacatctccaaataacatgcttatattgggccaggtgtggtggctcacacctgtgatctcagcactttgggaggccaaggcaagcagatcacttgaggtcaggagttcaggaccagcctggccaacatggcgaaaccctgtttctactaacagtacaaaaaattagcttggcatggcgacaggcacctgtagtcccagctactcaagaggctgaagcataagaattgcttcaacctgggaggtggaggttgccgtgagctgagatctcaccactgtactccaaccttggcgacagaacaagactctgtcctcccccaccccctgcccccacaaaaaatgcttttattgcaatttctttatttttcattttggaccttaattattgactcccactcaggaaggtgaggttttagtccatttcctaattcttctccagtctacatccccgccccttcagtttcccagtatagttacatgatcattttagttagcttagtactcaagatttacattgtatgatatgtgtactaattagagctggggcatgtgataaactatgattacaattcctttcctgtacaactttttattgtataagaagttgcctttttgtttgtttcaaattccttttttttttttttttggagacagaatctcactttgtctcccagggttggagtggtgtggtgtgatcatagctcactatagcctcaacctcctgggctcaagcgatcctcccaccccagcttcctgtgtagctgggaccataggcatgcatgcaccaccatgcccagctaattttttgattttttttttttttttttttgagacaagctgttgcccaggctggagtgcagtggtgagatcacagctcactacagtcttgacgtcccaggctcaagtgaccctcccagctcagcctcttgagtaggtgggaccacaggcacacaccaccatgcttagatgatttttttttccatagatgaggtcttgctatgttgcccagcctagtctcaagctcctgggctcaagcaatcctcctgccttggcctcccaaagtgctgggattacaggcgtgaaccactgcacctggccaactgttttgatttcttgtagagacagggtcttgccatgttgccctggctggcgtcaaactcctgggctcaagtgatccttggcctccaggtgtgagccactgctcccagcctcaaatactttttaataactgaaccccaaactctcctccaattgtctaaacacccctcaattgtttcattcacacaaaatatggtatcagtttccctttcctgaagaagtctctcccaaagcagacccactccaacctggccagcaccccatatgcctgtagcacagctgtcctcttgggatccggcttttcaatcacctcagggttctcttacttcacttgtatgttgcagctcctgtctcctgtctcacgtgatttctctttcttggtttactcccttgttttgaagcagattccacaatagcttctggaatataagggaggttatggaaggtacatttttgaggccttgaataactttaaatgtctatattctaccccagttcttgattgagggtttggctgaattctagtttggaaaccatttttctttagacttgaaagcactttccatttgttttctagttttcgatgttgccaaggagaagtttgaaattgatctttgttcttttgtatgcaaacattttctttctctttggaaacgactggatgttctcattgtttccagggaactgaaatttcatgatgtgtgttcatgtagatctgtttcctttcattgtggcttcttcccaacacagcaactcaagtgcttcaattctaggaagttgccttgaattgggatggccctctgtatgttttctgttctgtcttttggaacttctattatttgtagattagaactgctcctctaaatttcttatttttctttcctctttccctctttctctacacacacatactttattggagattttctcaactttatcttccatctacgaagtttttcatttctgctatcttgtccctcaccccaagcccccgaaaccttcttttggttctcttaacctccctgttctatagcaaacttttcttgtttcatggatacaatatcttcttctatctctttgaagatattgtagtaataatgagtattttaaggtttctctttttcacgtagtctctattgcctcctggttgattttcttccctctttgtatgctttaacctctggctttcatgttagaagcgtacctcattttaaagactggggtagtacaggctgattgggctagtagaggctgattggaggtgcagagtccatggaagagtcctactgactgtgagtttcatcgtaaaatgatctcaatgggctgtttgagggagaacatccaagaccaattcacttagagttttcctctcaggttggataagaatctcagggaagattcttccattctttcgctgaagggtaaaaacttgggaacctatagagtatcaggaacaaagtaggggaagagactgggatcttagcattcattatgtatattgacttaatcattttgttctcagttgatatccttgtttagagactatttgttttactctttgcaaagagtcaaacctccagtctttttggggaattctggaggcagttagaaagaagagcacctatagacttcggcaggcttcttcataaaatagttttaacaagttctccttattttggccgttccacttttactctcttttctagaagaaccttgtgccactaattcctgagacttttcagcattgtacagtgtgaaacagattagtgttcagcttttcccagagcagctggggaatcaggttttctaaactagataccacttgcatgtatactttccagttcttgaaatctctctctcccattctcctattcttgtagggttttccttttaaaaaaatccccttattgaggtgtgaactgtcagtcccctgccccctgctccatctacttaacctgagggcttagaggaggacatagcactaacttacctaacacattctcaccaaccaaggctctcgtcacctgtgatcaagggaacctgccccatagtaagcaccttatgggacactctgctctattccccagggaaggaagaccaaagtgacatctgagctggcccttaatgaggattctagaggcaaacgatgtagggcagagcatctcggtctgcatcaacaatacatatgtgcaaaggtacaggctactaaaaggccacagcatgccctatatctgattattccaaccagtgggttagcaggatctgggatgaagttggagaccctgtgctaaatcacctgcccccagtcctagtctgccacctgtctcctcagttacgtggatatcctttctgtttcccaggcagttggcccaacgagccctgaaccaagtccagcacaaggccttggtcagccatgatgaattaaggttcaacagcctaatttgatacctgttctcatcacatcctccccaccaagctgcaggcagaatgcatggcacatggtttccttggaacagttttctgatagttctaccgtctgagtcctgtcatgaaggctctctaaggaacaagactagatacatcatatgatcacctgtgtgtgtgtgtgtgttacttaggacaggagccaacatggccataacttaaaccaaatagaaggtgtatttaatgtgggttctgattcactacatccgtgaatgtgccctcatttagaaatatagttgttgcaggtacatagtacagatataatcagtgaagctcatactgaagtagggtggggccctaatccaataagactggtgctcttagaagaagaggaaaagtgggctgggcgtggtggctcacacctgtaatcccaaaactgtaggaggtcgaggcaggtggatcacaaggtcaggagttcgagacccgcctggccaatatggtgaaaccctgtctctactaaaaatgcaaaaaattagctgggcgtggtggcgcatgattgtaatcccagctacttgggaggcagaggttgcagtgagccaagatggcaccactgcactccagcctgggcaacagagcgagactctatctcaaaaaaaaaaaaaaattaaaaaataaaaagaagaggaaaagagacagatacactcaaggggagcaccacatgatgacggcagcagagactggagaggccaagcaatgctgaggattgcaggtgtgttcgtcactgaggattgcaggtgtgttcgtcaggattccccagagaaagagaactaatattatatatgtatacatacttacacacactacatggaattgggttactcagttacagaggtaagcaagttctaagatcttcagggtgagttggaaagctggaggcccaggagagccaatggtttagttctagtctgagtctgtattagtccgttctcgccctgctataaagaagttcctgagactgtgtaacttccaaagaaaagagatttaattggctcatggttctgcgggttatacaagcttcacttctggggaggcctcaggaaacttaacaatcatggtggaaggcaaaggggaagcaagtactatcttcacatggtggagcaggagagagcaagcgaagggagaaacaaccagatcttgtgagaactctaccacaagaccagccaggtccatggtgctaaaccattagaaccaccctatgatccaatcacctcccagcaggccccacctccaacgctgggaattataattcaacacgagatctccgtggtgacacagagccaaaccatatcagagtccaagtccgaaggcctgagaactggccttagtagtgtagttccagtctgaaggtcagcagtcttgagaccaaggaagagtctatgtttcagttcaagtctaaaggcaggaaaggctgggcggcggctcatgcctgtaattccagcactttgggaggccaaggcgggtggatcacctgaggtcgggagttcaagactagtctgaccaacatggagaaaccctgtctctactaaaaatgcaaaattagcagggcatggtggcacatgcctgtaatcccagctactcaggagggtgaggcaggagaattgcttgaacctgggaggtagaggtttcggtgagccgagatcgtgtcattgcacttcagcctgggcaacaagagtgaagctctgtctcaaaaaaaaaaaaaaaaaaaaaaaggaaaaaagctgatgtcccagtccaaagccattcaggcagggagagtcagcctctttgttctattgaactgattggatgaggcccactcacattaggaagggaaatctgctttactcagtctactgattgaaatgttcatctcatcctaaagcactccatagaaaacacccagaaaaatgtttgaccaaatatctgggcagccagaaaggctgacataaaaccaaccatcatagctgacagcaccaggaagctaagagaaagctgtggaacaaatactaccctggagccttcaagaagagcatggccatgccgacaccttaattttagccttctgcctccagaagtgtaagaaaataaatttctcttgtttcaagtcatcctactttgtggtactatgttacagcagctaggaaaataatacagtaggcttctaaagcattttttttgagacagagtcttgctctgttgcccaggctggagtgcagtggcacaatctcagctcactgcaacctccaccttccaggttcaagtgattcttgtgcctcagcctcctgagtagctgcgactaaaggtgtgcaccaccatgcccagctaattttttgtatttttagtaaagacaggctttctccatgttggccaggctggtctcgaactcctgacctcaagtgatctgccccacggcctcctaaagtgctgggattacaggcgtgaaccgctgcacccagcctaatgtatttttttctagtcatttccatgggtaaatctttacagccctagattttgtctagtgctacagtgtgcaatagagtagccactagctacatgactatttaaatttaaactaaaattaaggctgggtgcaatggctcacacctgtaatcccagcattttaggaggccgaggtgggcagatcacttgaggtgaggaattcacaaccagcctggccaacatggtgcaaccctgtctctaatgaaaatacaaaaattaccggggtgtggtggtgcatgcctgtaatcccagctactcgggaggctgaggcaggagaatcgcttgaacctgggaggcagaggttacagtgagccgagattgtgccacttcactccagcctgggtgacaagagcgaaactccatcaaaaaaaaaaaaaaaagaaagaaagaaagaaaaattaaaattaagaacattttaaaaattcagttcttcagttacactattcacatttcaagtgctctgcggccacatgtggttactggccactgtgttagacacaacagatactagatcatctccatcaatttgcacatttccaatgtacaaagttctgttggacagcattggtctagtgtattagtcggttttctcctgcaataatactgcatagcaactccagaatttcagtggtttataagaataaacatttttcttgttcagaggtccatggggcagctcaactttaggttgcaggttggctggacttggcttcggactgcagtttaggttcagatctgctccatgtatctcttatcctctttggactcaggtatgttcctctcatgactaaaagcaggagtgcaagaaggcaatctaaaccaatcatattcagttaacagtccattggctaaagcaagtcacatgaccaagcctaatatcagtgtcctcaaggagaggctctacaaagttacaaggcaaatggtatggatgtatcatcctactataaaggagtgaagaaaaaaaaagtaaaggaatgaagaactgggaataataatccaatctacctcatgtgccaaacgcttataaagaccagcctgggcaacatggcaaaactctgtctctatgtggtggtgtgcacttgtagtcccaactactagtgaggttgaggctggtcttgaacttctgggctaaagcagtcctcccacctcagcctcccaaagtgctgggattacaggcatgagccaccacactggccatccccgttggagttgcctctcatatatatataaaataataatatatataatatatatatttaccttggtgcttttctttttttcttttttgtgagacaaagtttcactcttgttgctcaggctggagtgcactggcgtgatctcggctcactgcaacctccgcctccagggttcaagcgattctcttgcctcagcctcccaagtagctgggattacagacacctgccaccatgcccagctaatttttgtatttttactagagacggggtttcaccatgttggccaggctggtctcgaactcccgacctcaggcgatccaccagcctcggcctcccaaagtgctgggattacaggtgtgagccactgcgcccagccagtgctttttcatattaatatacatagacacaattcttaaattaacattcactaacttacatttactggtttctgtgttctgctggtccccctcttaattaacttaacgatggttacttcagatatctgaacaatggacgtgtgttgaaagacaacacaacctgatttttgccactgggctggctcccaatctggtttaggtgtgttaacaggctgggcccgtcgtctcaagcctgtaatcccagcactttgggaggccgaggcaggcggatcacttgagccaaggagttcgagaccagcctggccaacgtggcgaaatcccgtctgtattaaaaataaaaaaaattagctgggtgttgtggagcatgcctgtaatcccagctactcgggaggctgaggcaggtgaattgcttgaaccggggatgtggaggttgcagtgagccaagatcacaccactgcactccagcctgggtgacagagccagactccgtcttaaaaaaaacaaacaacaacaacaacaaacactgttaatagaggttcttgagataagttaggagtttcatttctcgcttacaatatcttttgtaactaatttgattttatctctcaaactgaagtgttatagacctggtagagtagattcaaggcagctgctctattctttttcttctttcaaaatggttatggccagcatgggcaacatagtgaaatcccttctctactaaaaatataaaaattagctgggcgtggtggtgcacgcctgtaatctcagctacttaggaggctgaggcgggagaatcacttgagtccaggaagtcgaggctgcagtgagccgagatcgccccactgcacaaaaaaaggttgtagtaaaacaactgctctaattcttacccccttagctagtgaaaagatggaaatgcgacaggatagagcgcgacgagtgcttttagggctaaaactgagtgggtcacacacatggcctcctctcccacccgctcctggccagaatttagtcacatgagcgcatctagatcgcagccagacggatggccacgtgggagtgggaggtgatgccactaaaagagagggaatgcttggggaacaatcagcagtcttttctcagggtttgagaaaacactgtgtcttagtgagaagacacagtctgtgcgagttagtaaagtgaacagaactgagtagtcagctccctagtcaagaaattgaacagtcggcagagtttgagatttcttaacgtaaaggaagcgtcaaaagataaaggacccttctagccaggacgcaagactgagggcgagacagccacgcggaggcggggccgccggcggtcgaaggtgcgcgcccggccgacggtgcgcgcccggccgacggtgcgcgcccggcaatggggcgtggccaggcagagaggcggggctccaccgagcgcggcgctgaagctggcagccagaaaggggcggggcctggcggcgataggctttggggcggggcttccaaaccgggcgtcccggctagagtgaaggggcgtgggcactcataggctattgggggagaggttaagaaacgtagaatttcgcagccagaatgggtacgtctcagcgatcctgaaagcagccttgacagccagaggcgagtcaagtggaaaggctggccgggcttcgagaagggagggggcatcgaggtacttaaaggcctgaatcgcgcggcgtgacgtcgggggcgcggtttcgcggcgtctgggcggacactgcgccgaggggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacaggtgaagggcggagtaggctgggctgggctgggtttgaggggaggggtgcggtctcgtctccgctcactctgctctcggagaggtaacagtcacttcagtagctccgattgtcttttagtcgaccagatgctaggcgctgtgggtgtagcagcgaataaaatgctgctccttgtatcttggagcatacctttgggcatatatgcttgtttgttaagaagcccatttattaacaaatacgtattgagcacttactctgtgtcaggcactttttaggcatttggagtacatgtgtgaacacaaaacttcctgtgcttatggagctgttaatactatggaaagatattctagtatgaaaaggcagacagtaaacatagaaatagtagattctacgccgtgataggagaggagggagttacattttttcagtaagatggtcagggtaggactcgtgaaggtgatgtttgagcaaggacttgaaggaggtgattcaggtagcaagccatgtgaatatctgaaggaaaaacggtccaggcagagggagcagccagtaaaaaggccccgaggcaggagtgtgccctaatcctaactgcaaggctgcctgtgtgagggggagagtagtacctgaaagaggatgtcagagaggtagtggagaggcagatcacacaccttataggcttttactgagtgaaatggggagccatggcagggtgttgagctgaagaaggacctgacttgtgttttaaaaggatcactattactgctgtatggagaatgaattgtcttggatcatagggtggaaacagggacgagttaggaggctgttggaataacccaggtaagggatgatggtggcttagatgaggcagatagcagggaatgtcattagaagcagttggattctggaaatactttgaagatagagccaacacgatttgctgacagtttggatgggaccttgacttaataacttaaattgactctactttcgtattttcaagtaaagatgagatgggagttttataatcgcctctgatcaggtttttgattaagaagccaaaagcaaattcagtcctgcaataaggattttgggttcttttatgcttcaaaaagagtattctgttaccactcatttatttgcccttttctttcaaagtagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggaggtgagttgcacttgtggcatttgagtgcgattttgagaagcattcaggaaacatttatttactgcgtgctttaaaggcagagtagaaagagcaagtactagcctgtgaactgagccgttgggcttagctttgaactacctcactgtgtgactgggtaagtccctttgcccatagttgtgtcctttgtgaccttctggagggagttggggtggatgatctcttagttccacatccataattctacaatattataattctgacataatggggagatagctaacatagtatctgcaggtagtaggcattcagtagaaatgttttgaataaatttaatcgagaccatctttgtgttctggagttttttttgttttttttttgtttttgtttttgtttgtttgtttgtttgttttttgacagagtcttgctctgttgcccaggctggagtgcagtgggatcttggctcagggcaacgtccgcctcccgggttcaattgattctcctgcctcagcctcccgagtagctgggaccacaggcacctgccaccattcctggctaattttttttatatttttagtgagacagggtttcaccatgttggtcaggctagtctcaaactcctgacctcaagtgatccaccctccttggcctcccaacatgctgggattacaggggtgagccaccgcgcccagccaatttcaagttatttaatcactattgtttagacctttcaggtacagtgcctggcacgtaatggacccttactaaatattttcaagttgaataaaaggcaagggtagtttatgtcatatttaaaaatctgttgccactttatcgttgagctttaactgtctgataagagcctaggccaccactgtgttctcctgaggtttctcacattggcacaaagagacccacgctttacagctgaatgcctgggtttgcagctctgctacttaacttcctcacttcatttcctgatacgtaaaattgggaaaaactgatttcccagggttaccctgagaatgaaatgagataaggtaggtaatggcactttgtaaactgtaaagcagactgaacatataaggcaaataccattgaatttctcatgaagtttctatgaaaatttttgaagaaaaaagtaattcttaggtgttaccaaatgctcctgatgtatgaagttctctatgtaaacagaatatgcaaaaataaaaagtaacatattttatattgagagaaaattacctgaaggctgggaaattatcagagtgaatcatatcgtgttctatgctggcatctgctggtgaggtatgatacagcagtgacattttagttccctacagtaagttcctagtgctctgccacttactttctcacattaggaaaataaaattattctggttcttttacagtaagtcaggatgcgtgtggttacttaacgtgtttgcttcagtagatgtggagtgttaagggagggcttcttaaactctggccttcagtcacctagggagctcattaaaatgcagatccccaggccccaccccagagcagctgtgtcctgggaattggcatgtttaaaatttcccccagctaattctgggatacctggtcccaggactacagtttgagaaatatatgacgagactcattaagatctgactggagtgcatacttgttaggtggccgtgtgactgtatgggtgagctaggaatgcctgcctagataagaggttataccaggggaacttcaacgtcccttctgactatcaggttttgtatttctcctgctggtctgtttcttctttatctgccttaaattatcttgtttctcccaagatgctccatatttctgtcctccagaaatttcagtgctgttttctactgcttggttatagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaaggtatccaagaggatgtttgcctgcagcttttgggtgttgtctaccttgtattccttaaattattgccagcatgattctttgcttgctcactttttaagcacctccttcccctttttgtattccctttcttaaactattcagtaaactgataacttatgttgtataggttcccttcacaaatggtagcttttataacttgcctttaatacagaacttggaattgcacaactttcagcttttccagatattaaatatttttaagagtgagcagaacatatcagactaaaaatatcttaagctagaaaacaattgaaattgttttattatacccttataataacatctatgctgcagaaacacctctttttcttttcaaacttgtcttggacttttggttgtattttacttcaaattaaagtatgagttttagttgctattgtcacatgaatgtgatgaaaatatcttcctcgtgaatttaaatagttcatataaaaccaaaggactacggacaatgccactgtgaatacaactctattccaagaatggatttgcttgttgtcattgagggtactgatctcagctgaccaataatgagctcctgaaggacaaaaactgcatcttttttttttaattgtgaaaaccatataacataaatttgccattttaaccatttttaagtatacgtttcatgtgtgaagagctgtgttttaattaactttagaaagcatttattaaacatctgttattcctgggatacaaagaagttgcgggagacagatagggaaataaataattgatgaggacactcagtccggagagttagaggcttgccagaagacacggctgaggcacacagctctccgtgctcccacttctctgttctccagttgctctggtattgactctttttttttagttaactttttcttttacaattctatgatatgattataaagagagagcatgagggaattttttgggatgatgaactcttccgtatcctgattgtggtgttgattacatatgctttctctttataatcatatcctgtttttatccacaataaacaggaacaaactactgatacactcaacaacttgaatgaatctcaaaggcatgatgttgagtaaaaaaaaaaaaaagtttcaaaaggtacatactatttgattccatttatgtgacattttgaaaagataaaaccatagtgatagagaagaagtgagggaaagattgcctgggcttgggatagagacaagcttttgggtgaacttgttttcatttctccagagtaaatagattgctgggtcatgtgcttgcatggtatgtctttccgtccttctacttttaatctacctatatcattatattcaaagtgaatttcttggtagttggatgatttttaaaaaaaatctattcagtcaacctctatttaattgttagactaaaccatttataattagttttaattattcatatgcttggatttaggttcaccattttattatttgtttttgttccttctgtttattgttcctctgtttctctctcctgcctccttttaggttattcgagctttttttttttttttttaaagtattttatctgttgtgttttttactctacctttttattgtagtttttagtggttgctttagagattacagtaaacacaacttttcacagtctacttagattctgtatttaccacttcaaggggaatgtggaaatgttagcaatgtacagactcctttatttcgcccggtttatcttaaagttgtcttatttatttcatctgtatacattggaaacccatcagacagtgttgtgatttttactttcagttgtcaaataggttttaaagaactcgtaaggagattagtctgttatgtttaaccagatttttatcatttctgttgctcttccttcattcctgatgctccaagcttccttctggtgttgtttctcgctgaagaacttacttagcagttcttttagaacaggcctgctggcattatgtccaggtttggtagctgcttttagttgattgagtggattcagggattggatggagtgtattttctccatctgacctatgtctgaaatgctggtactgactttaaaaaaaacaatggagtcggccgggcatgggggctcatagctgtaataccagcactttgggaggccgaggcgagtggatcacgaggtcaggagatcaagaccatcctgggtaacatggggaaaccccatctctactaaaaattcaaaaaaattagccgggcatggtggcaggcgtctgtagtcccagctactcaggaggctgaggcaggagaatggcgtgaacccgggaggcagaacttgcagtgagccgagatcgcaccactgcactccagctaggtgacagggcgagcctcccgagtacctgggatcacaggtgcccgccaccacgcatggctaatttttttgtatttttagtagagacagggtttcactgtgttagccaggatggtcttgatctcctgacctcgtgatccgcccacctcggctccccaaagtgctgggattacaggcgtgagcccctgcgcccagctggtattgactttaattgttgtgttaatagtgtttccatttcataactttcaaaattgtttctttgaagaattacacaaatggcggtgtcctgattattatgagaataatgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggtaatagcagacacagggacgggcgcccttccgtgttaacaagatagtctcagaagattttcttgcatatttttccattggccttaagatgctttgactgtttgtcacctttggggtcacgaaggagtccagggggatcatcagcatagaatacagtgtagaagcagctgtttctgaaagagctgtggactccagcattatttattttcaccttataaactcctttatgtttttaaactttgtaagtgtagcatacatgatgcaaagtgcacaaatctttatgtttcatcttgatggattttcaaagtgaaactcacccgtgtatctgctgtcaggttaagaaacagcattgtcagcgttccagaaggctcctttcatgtctcctcttagtaactttcccaccttccttcacatcccccgccccaccaaaaaaaaaaagggtaacaaccttttagacatctgtcaccatcattagttttacctaatcagttgttgctggaactgtgatgcaatgctagcctagagacagagaggtgggcagctgtgtgaaactggaggcagctggaggcgtggctctgggcagggtaggccaggggagctctggaagccctctccagctgtcgttttctccgtttggctttgaagctactttccttcctgtttgtgactgctctgttttcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagaggtaacttagggccttggaaggagcagcccttcttgaggggaggagtgtcctgagaggcctgacatcaaaggggttgtgcccagagtcaggagggaaagagagcagaggggatgtgggtggtggtggagatggcactgaccttgtaccaactgaaattctgtcagaagggatttcaccctgtagatccccggacccctgagcgcagaaagtgcatttaacgtaggaagaacattcacacaccaaacctgtggtgctgtcttgaacctaaaccagctccactgatagtcattggcagtcatatacttcctttaattttcttttagtgttttattaaatatattgtggttgattgttcacttacctcctttccatcttgatgttccctaaggacagggatcatgcttcatacatgatttatgaattttttacagcagttggtagttatgctcaataatatatgtataggttgccttaagatcagccttttattagttgctaaagaccctttgcataagctctttgattttctcttcttcttcttcttctgtttcctcacccgtgcactgttaataagtgtttttgaggccgggcgtgctggctcacgcttgtaatcccagcactttggaagtcccaggcaggcagattatctgaggtcaggagttcaagaccagcgtggcccacatggcgaaaccctgtctgtactaaaaatacaaaattagctgagtgtggtggcacacgcctgtgatcccagctacttgggaggctgaggcaggagaatcacttgaacctgggaggcagaggttgcagtgagccgagaccgctccgttgcactccagcctgggcaacaagagcaaaactccatctcaaaaaaaataaataaataaataagtatttttgtttgtttgagacagggtctcactttgttgcccagttagaatgcagttacatgttcatagctcaatataacctcagactcctgggcttaagtggatcctcccacctcagccttctaagaagctaggactacaggtgaacgccagcatgcctaagtcatttttacaattttttgtagagatggggtctcaccaagttgtccaggctggtctcgaactcctggcctcaagtgaacctcccacctcagcctcccaaagcactgggatgacaggcttgagccaccatgcttggctgttaataagtgtcgaagtagccaaaagagcttaggccccagcatcttagttcctgtatggcaaaggggcagcctgcaggtcactcctcagtccagaagtcgctggttgagtcgcctgcctttagaactgaaacaaagagtaagtgtacatcctgttcctggatctgtcatccctagaattccaaaacaaaggaacttactgccttgagacatgttttaggcaggataaaccagactagcctcttgttttttgttttttgttttttcctttttaaatcagctttcattaagctgttgattacttatcctttcagaaaaaaaatgatactttggaaaaatgcaagtcagtgccatttgatgctgggtgtagcatagtgcttatcagtgatgtcagagttgcctttggctcaacaggaagcttgcttttgcagtgatgggctcccagctggaggctcgctcaaggttctgctctcaccgttgcatcctctacatctcattcccaggctgtcgattatgtgaggacagtacatgagtgtatgctttatagagcagatcctgagataggcttactagatacaccttattggatcaccaagatcttgtgtagaaggggcctttaccatcttcttccaacacagcatcccagatcagcctcagttgaatcagtgtgtgccttttccattttgcttctcttggtttttcaggtctttgagatttgagttgttgtttactgaaatccggaaccatgttgtctttgttatgtattcatccatatttagtttttatcatgcttgacatgttagcaggacatagttttctttataccagagcagtgccactcagccacaagcagatgagggatttcagatttcaaaaagggaaaaaaaaccaaacagctgtgaagatgtgattcttcagcagtggggaaactagtttttccttttctttgttcatttgtctgcatttgttacatgatgtgattcatcacccattcccccattctttcagcagatactcagtaggtacctacttcattttatgctctggtacacacatttaaatctccttgggtttaggggattttgaaatgccggactgcaaaagatttttctatatgcaacaaatttgatgatcagttgggccgggcacggtggctcacgcctgtaatcccagcactttgggaggccgaggtgggtggatcacctgaggtcaggaattcgagaccagcctgaccaacatggtgaaaccctgtctctactgaaaatagaaaaattagccgggcgtcggggcaggcgcctgtaatcccagctactcgggaggctgaggcaggagaatcgcttgaacccaggaggcggaggttgcagtgagctgagattgtgacattgcactccagcctgggcaacagagcaagaccccgtctcaaaaaaaaaaaaaagtgatgatcagtcgtcaaagctttaatggttagtcagcattcagcattttagggtaattcttaatgatcagagtcaattacagtcacatttgtgggataaacttgaccatgacaatggctagccagttctaccattcaaaaagtatttgtagagtttccaataatataattcatttagaatgaattgaatcaatatatgtgaaccaaaattcatattgaaattgcacttaagcagtaatggctgaactgaattaatacagctggaatttaactaatagaggtctcgaaaatctattttttcttatagaccaatctattctgacccttgctattctgcagttgtttctgtgaggatgttgtgaaggagcaggctttgttagcatttttaccaagtatttaaaccagaagatgcttgcttttcatagctacaagcacagcataagagggtaggaggggggagaacacaggttttgagcatcatcatttgttggaaaacgcaatgggccaaatatagaaagttctccggctttactagccaagatcagggttggcctctgcttcttcttatgccgctcaaggctgttttagggaaccatgctgcatcttctgtggtatgccttggcaaactgtcattccctgcagttccaaaagaacagtcatattagtgtttctgaacgccacataagacatgtggagaccctggcaaactctagcgagagagaagccagccgtggcagagaaaactattctctgttggatgcctgttctctgtgttgaaatgatcagctttgttcctctctgcgacttgtatgaattgggataaataaatgtcctttttataatttttgtgaagctaagaagttatcttaagatggtatgctttggagtgaagctaggtgaaggtgaatgttgatttttttttggcagctgaagaaacctcttgaaacccaaagctttacaatcatctctatttcaggggaatttgagggtgtatcccaggggcccaccactcagtgacaggtgcagtataccagggatgcagaggtgattaagatacaatgcctgccttcctgggtacctcaaaaacaaaaaatgagggctatagcaccatgcttagctgactgtaatgaagcgtagcaggtatggtggtaaatgtgtgtgggaatacacatttggttttttgagaaggactggatgtttcagctgggccttgaaagattatttgggccgggcacagtggctcacatctgtaatcccaacactgagaggctgaggagggaagatcacttgtgcccagcgctttgagaccaatccctgagtcacatagaccccatctctaaaaaaaatttttttaattagctgggcatgcatctgtagtctctgcttgagaggctgaggtgggaggatcacttgagcttgggagttcgaggctgcagtgagccatggttgtgccactgcattccaacctgggcaacagaacaagaccctgtctaaaaaaaaaaaaagaaaaggaagattatttgatttcagtaggtagcaaaaggaggagggaaggacattttaggtggaaagaaccacacatgcaggcatatagagtgtgaacaagaaaagctgtggtgggtgatgaagtggagatgactattaagttctttacccatcagtcttatgagcctgcatattatccttcagacattcggagccttccagggatgttgagcaagggaatgagacgatgagattttgttttgggaaactaactggtggcagttaggatgatgggttgaagggaggggtgagactgcaggtgggaaaacaaaacagatgtaggatcagatgtaggatcccaagatctcgctgccatttgcaagccaaggtgacaagagtagcagtgttgataatagagcatgtggcatgtgccgactccttgctgagcacctacgtaggtgtcctcctggttcgtgttcacaactcaatgggtaggtactatcattatcccccttttacagacaaggaaagatttggagtgaggtcacatagctagaagtagtgctgatcaaattcacacacaggcagttcaattccagattccacccttgtaacccttaggctgtattgaaaggcagtgggtagatggtagtgccttttgaccaagtttgggaagataattggcttagttttgagcaccttttttttttcttttttttaagagattggatcttactctgttgcacaggctggagtatatgttgtgatgatggctcactgtaatttatccttcagacattcggagccttccagggatgttgagcaagggaatgagacgatgagattttgttttgggaactcctgggctcaattgatcctcccacctcagcctccctagtagctaggactacaggagtgcaccaccatgcccggctaactttttgctttttaattttttgtagagatgggtctcactgtgttgcccaggctgttctcgaactcctggcctcaagcaagcctcccaccttgcctttcaaagtgcagggattacaggcatgagtcaccgtgcctggccctgagctccttatctttaaaattgttgtaggacatcaggtggagcttttcagcactctgtgggacatcaggtggagctatgggaggacagaatcaaatggggaggaagaaaagaaaaattcctggagaatgccaccacttgaaagttaggtgacagaagaaaagccaggacgaagattgagcaggagcagtaagagataaaggaagccaaaagggttgatgggagagttaaaagcttgaatggtcagcttaacctaggatgagaattattttttgaaacaaggaaagcttgaaaggataagaaaataggatgtgagggtgatctggctgcgatatctgtcaccccattgattgccagggttgattcggctgatctggctggctaagctggtgtctttctgtcctcaccacttcgtgtgtgtctctcccaaagctgcatgcttggtcgaagaggacgaccatccccaatagaggaggactgatcttccgtcaagagtatacgagtagctgcgctcccctgctagaacctccaaacaagcgctcaaggacatgaaaatagataaggaagtagaatgaagaataaagagggaagttcattttttgaggcaactaagatgatcttttaagatttccagggttgagattagaaaggagactgtggagaagggtgttgggaaagggcaggcagaaggaagctgagaagtaaccacaggattgcctaaatagcacctgggactttctgcactcctgcccccctggagcatatttaacttttctattgctacaaaaaccattccaaacttagcagcataaaacagcaaccattttattgtgctcatgggtttggtgggtgaggaattgagagaggctacagggatctctgcttcaagttgcctggagccactgctgggaagaattaaatagttggggactggaatcagctggagggttttttacttacctgtctggtatctgggctgggaggactcaaggtctgggttcatgggggactcttgacccaggcacccacatatggcctcttggtgtgccttgggctcctcccagtgtggccactggtttccaagagggagcttcccaagagagcagctagagagtgaatgtttcaaaagatgaaagcataagctgcatgacctttcaggaccttaccttagaagtcacatgacatcatttgcaccatactttgttggttgtagtcctcacagtcccccactgagactcaaggggaggaaacaaagaccctccacctctgtttggggagtgtcaaggtcacattacagaaaagtgtgtgggatagaagtcactgttgtgaccttcttttaaaaatataatctgctccggagcccaagtggaaagagtactgggaggcatcctttagactgcaggcttactggttgggtgtaacagaagcagatagagttggtggagggatgacggcaaaagtgattggattccaggctgggtagagaagggcatgtgaatccacaggaaaggtcatcacttggattgagggaggctggagtggaggttaggatgaagatgaagaatagggtaaaaatgtgggatgtagagaggaaggactccagtggagcccagtgcttgctttcacctgttacttggggaatcacaggttacaggttttgtctgtagttattttaaatacacagatgacatctttgtcttcaacccagtaatacaacagaattatttaagggaccaaattgagtgtgtgtttaaaagggaagagggaagcgttgttcgtttctcacccgacgctgccctaagttcacgtcccacttttacatagatggagaagcagctcagagtgtactgtttccagctctagtactgtgacctttaatatacctttggttgccattccgagctggatcagtgtgactccagagcctgaccaccttctgttatgtcacactgcctcctggttcctggttcccccagatgacaaaccaccaaatgaaaaagaactttgatgattaatttccattcctcccctggaacccctttggggtcattcctgaagagctgggtttggtgccaagccagaataggcacagacactcccatggtagggctcctttcttgtgagggaagctgagagtcttccagatcacaaactgcagatggcaaggggaatgttcctttactccctctctgctgtccctgctgggacagaggagcctgtcattgcctcagctggtcttgctgctgcatgtaaaatctttcattcatctcttgtattacctactctgacctcaggctagattgttttcatgttcctaaagccccaattgtcttatccttagcctcatgatttatagaactccagcttaaggcagaacaaagactttggaactgagcagttctgcctcttcccacatgtccactgcctactagtgtgatgtgatcttgggcaagttacttcacctctctgagccatagcatcctcacccatcaaatacagtaatgtctgcagtgagggttgtgcagatagcaggtgtccctcccctctttgtctgattcagtattggcagggacagcttttgcttccttccctgagagcaaggttctttagattcgtgtcacccaacccatcttcctcctcctcagattacctctataaaccagccccctcatcctgtgcacaagtctcacatgaagaaacattcactttcctttccagggtttatcctcaagcctggaaaatccccctcaaatactgtagaatcatctatactgaacagaatttagagtacattgtcacccatcttgcatgccatatttgccacatgacttttggtgtgtgaatgtgtgtggggtattgaggggtattgccttattttaatgctagtttacatttgcagtatatatgagtaggttctagagaagtatatttaagtcctctgaattatgttggtgatttacatacttcataaattccgagagtaaggagagactcagaatgcatactcaatggcgcagtctcctctcaagcatacttggctttggttacactctgcttgaaccctcccaagacactacctcataagacagtccattctgcagcagctgtcattgttacagcattcttccttgggatgcaactaaatatttctacccagaacttctctccattgagtctaatgacagatggctaaagatgtctttcagaaccaccaccatccccaacttattttgtacagtttaaaattaaaagcaccctaacttctcttttggaaatggtgccagcatgtctagaccccttccaggttcattgtggtcatagagggaacttgttctgcaggactccacagatagcaagcactctgctaccttggagcctctagtcgcattcccagcccagtgggacctgctattaagggactgattgttgagctcattagcgttggcacatacatttatttatatttctgaggcagagtcttgctctttcacccaggctggattacagtggcatgatcatggctcactgtagcctcaacctcccaggctcaagtgatcctcgacctcagcttcccaagtagctggggctgtaggtgctcaccaccacgcccagctaatgtttgtattttttgtagagacaaggtttcactctgttgcccacgctggtctcaaactcctgggctcaaggagcccacttgcctctgcctcccaaagtgcagagggattacaggcgtgagccactgctccctggccagcagatgtatttattaattattaaaagattgctttaactttgctggtagtctagctgccttgtaggatagcagctgtcacacccttctcttagagttgcgtgtgtggtggtgtgactcatgcaagcagcaagtcttccacggggcccagccatgagctggcaccatcagaaggctttagagaaggcgggggttggtgaggcttgtataaagtaggaaaggtaggagatcaaagcaaagcccgttcctggctttttagtcttcgtgttcatgtgtgcttttttaaaaatagcttagaaaaattttcatagtttttatgtaaggttttagaacattgggcaagatcccagttcttttttgtggcactaaaatgatagaactgaggcctgctgaaggtacaggttctgtttcattttgctccttctcttagacccctgacctggagcagctggagccgtctttggaagatgtggaaagcatgaatgattttgatcccttgttttcagaggaaacacctggagtggagaagccggtcaccactgttcaggtttgacttctacagcccagaacatgcttattctttgaaggtgttgacctaaatggctgggctagtctgtttctttaggacttaaaactgttatgttttttagaaaattgggtaccaatacttaaaacatctgaaatcagggatttttttcccccggtgattgatcgattggttctagtaccaagatctgtgaatctctgagaaacagtccacccggcagaaacatttggtaaagtaattgggaacttgagatctgaatactggcttgtaatagtttcatttacatttaagccaatgccagtacacataatcctctttggaatctatgtttctgtcattacaatgccaaccagataaactgtcctgagtctgagacccacctgggagagagcttccttgccgtgcagggatagggcactaagcaaggcactgagcaggagacttgtcctctagactcggccttttactgctgctctccacaaagcctctccctgcaactcggggaccatttcatgatggaaacatgtacatgtttataatacacaggttggaagaaggtaggaaattgaattagcaggtcaagagagttgggagaagctatactggcattaacaagggacagaaactattgggattaagaaacgcagtttgaggaaactagcaactggaatgtttgtcatttggcctaaaaatatcttttaaaccttgggtttttaaagcccgtgtttaacttggcagcatatcatcagctatttgttgggacagaaagaattcgagctccagagattattttccagccatctctcataggagaagaacaggctgggattgcagagactcttcagtacattctggacaggtgagacagcgaatctgcttttccttctatcttcctgaaccatttccttggattttgcattgaatggtagatttgatggtcaggcacttgaaaatgcatctcactctcttcttttcattgacttgctgtgctcagatagtattcccttcatctcttatcaccaggcctggcacgtaactggggctctgtagttgttttctgaacctgtaaatgctgggttgactgagtagctttaagagtgtcttttaagtttgaacaacccgataacatgtacactggtttccatgtaaaccttcacattattaaagactagtgattttaaatcaccctaaaaatattgcagagctaataaaatttttttcccctccttgcaggcattttacttatttaagagttacatttccataagaatccaggtgttttacccatttatgcgggcattttcctgcagtgtgaatttgataattcaagttgggcaagtagagaatggaattttgtaggactctggctgctgttggtcataacggcagggaaacttgtacctagcaaggaagaaaaagctgttgctgctactttgtttgagtggctttgagctttgtcttgacagtggttggaaagtgatcaaacatgtcttagataaagctgttattaaaaaagataaaaagaaagcacaggtcgatagatgggccctcaaaagggaggcatggcttttggggataatggaaatgttttgtgtcttaattgtagtgatggttactggaatgtataaattagttagactttatcaaaatgtatgtaaatttatcctcaagtttattttttaaatgtattataaaagtataaaaattctaatcatgttaaggaaataagttgaccattcagattacggttttgtctggctgtttggaaacattgggctggcgttttgtagagacacaaatgaaaaatgaaagttttgattttttttttttttagctttttgtgtagaagtttttctgttttgtactgagagcttacatttctgcatccacatttcgttctgatatttgagttaagggactatattaggagttgtttctttcctaggtacccaaaggacattcaggaaatgctggttcagaacgttttcctcactggcggcaacacgatgtatcctggcatgaaagccagaatggagaaggaactgttggagatgagacccttccggtcttcttttcaggtactgattgttcgagtagtcaattattttgaaaatagcattacctgttttctgattgcaaaagtaataatcatgcagaaatatccactgttaacatttttgtggcttttcttctggtcttaagtccatgcttaatttttaaagcaaaatgggaatcatgttttatatactgttttgtggtttctttaaattggaagatgaagacatgcgtagaattctaagagtgtgaaagagtgtacatcaaaaataagtcattctcctacccagtccgggcccctgtagacattgtggggcatgggatacattggagcgttccagacagaaggactagcatgagcaagggcacaggggccagaagcttgttgagggagtgagaagtggctgagtgttgctggagcacatggctgataaagaggagaggaggtgggtaacgtagagaggtcagcagagcccacactgcagagcctgtgcatcctgctaagaagcttggccttggtctgctctgctttgctgcatgatgtcgtgtacattcaggggggcgtctctgggctttggtgctgactccatcatcaccattactgaattgtgctaagctttggctgtctcagtggtaggaagggggtaatcggtacctgttgctgggattcagtgtactggtgcctgtcaagcgcccgacagtgggcctgcatgtaataaactctcagacatgagctgttgtgttgagggtccctaagaccattccaggcaggatgattctctgggaggattcacaggactcagcttgtaatcctacttacagctgtgacttactacagcaactcagcagagagacaaggtgcccggggtgaaatctgggagcaaccaggtgtaagcatccgaggcctctccctgtggagtcacacaagacataatttccccagcagtgccttgtaaaagcacattaagtgttgccaaccagggaagcttgtaggagacgcagtgtctagggtttttatttgggggctgatcacataggcaccccctgcttggagcatacccaaattccaggctcacagaagggaagcacgtgtttggcataaaccacattatttgtgtgaatgggcttattgagccattcttatcaggtggtggtaggaaccctcccaatatccaagttcccagatgcctaccaaggccccacccttgtaagtatgcctttctaaggtaacagtagggtggtcctgttaactcttttctgcacagctcttatttttaggccatagtgatgaaccatgaaggagtctaagcagggaatgtgatctgatttacatttagtaagatatatttgacactgttgtgcaaaatagagtattaagagaaatattggaagcagaccagttaggaggcagcttcccagcctctaggaggaagtcctcactccactcaccaggatttacagggtctcttgtgttctgaccttaagaactgtccagggttctctcatcattcccccttccacccgctcgtcagccacagctaaccactattagttttccagagttttcctgcctcagggcctttgtacatgctggctccctttgcatagaatactctttctcctcatccagctttctcagtggctggtttcctggaaatcacttcctccaggaagccttccctgtctttccctatgttccttacaagatccacctcttgtaagggaagagacagccactgtcttgtgaaaagtgtcccaagcccttggcacagtattacttggtagctctgcaggaaatacaaaagcagtggcagagggagaggaagagagggagttgatgtgaaagaggctaaggcagtcaaattgtcagagcttgatagtaagttggatctggggagggaagtcggacctaagataattcctaaattctaagtggagcaactagtttgctgattaagagattcactgaacgaggagccgcgggagggaggacaggcttaagggagaggatagtacgttccatttccagggtgggttgagtttccagtggacacacgaaaaggtggccacagctagctggatgagcgctcggtgggtaagggggaaagcaagagggtagtttcacaccctcccacctgccacaaacataaaatgtgctctgggcactctttgggagggtagtgatgttaaggatgaacccctaaagaacactagcatttaagggctgtaggacacccatgagtctaagaaggaggtggaggaagaggagtggggagcaggagagagcagcagtgctgaagccagggggtgacagtaaggggcatgagcatggggctgggtcacgctggcagcggcgacttaggatgaagtagtagagaaaaaaatcgtagaggattttcaagatctatttcttggtaatttccaaagtctcccatgaattactctgtgagcattggttgtggaatgctgctaccagccagatcttttcccagccctgcttttgctgttatggtgtcacctggcctagcctcagctcccccctcccctcctgtttctgccccctttcacattgctaatgtaatgagtgtgtcacactgtcactaagccctaatgttccaattttagattatgtattcagcagtggctcaaacataccaaccacctaaggccctccgtgatcattagaaggaagagaaccccaagatgtgcaaatttacaactttaagttcctgttttttcttaaacagtaaaacatttttaaatattacaaaaatatcagacaatttaaaccaaaatgaaaaccaagaaaactgtagtttcagcctctgcgagcaatgttctttgtatactttccagtcgttttcatctcatgtatggttttaaccaaaaagagattggtgatagcttattttgtaacctgtatttttttcactttcaaattattatgacaatttttttatatcaataggtacatttccagagcatcctttttatggctgtatagtctattaaccatatgtcttgctgcattttttattagtaatgatgacagctatgctttattgaatactctgtaccaggcagcatctaccatgtgccttacactcatgcacttaaatcccctgaagccagggggtggggcctctggttatcctagtgacaaggtcctcattcacaggccccttgcccacgtggcaagcccagcagctggactcctgagcctgcactttcccacctccatttgtgcatgttgattccactgttatggcctctgcccttcagtcccgaaagttctgaaatcaccattctaacctggaactcatgggattggtggagtggggaggtgagagggaggtaggaagtgaggcgggtaactccagaacacaggaggcccgatggaagctgcagtgttaccataatgatcagatcagcctagccgagggccttctcagagctgctgaaccccagcccaactccagtgagaagcaggggaaactaagtgctggcagcctcacagagaacgcccaggtcacccctctctgctgccatttctcctgaggctcttttgctaccctggctagagctgccttgcagcggcccctgtttccctctactcagagtggggagcggggccaggaaggccttttccccaggtcacgggccagcctccacttcacctctccctgacagcttgtggttgacagcatcaggcagcaggaggctgagccactggcccctctctgaccccgagtgtcaggtcttatgttagtaaaatgtctgacagccgtctgttctggagagtctgggcattccagctcacctttgtttacagggtgtggagctagccccgaactgtcttggagtgcactgggcccacctatgtgtatatttctggggataaaatatcgggggctgtagctgagccaggtcaacattcactcctggagccctggtggaggtgtcctggtgaatctttgtgtttcaggttcaacttgcctcgaaccctgtgctggatgcctggtacggtgctcgtgactgggccttgaaccacctagatgataatgaagtttggatcaccaggaaagagtatgaagaaaagggaggagagtacctcaaggagcactgtgcttccaacatctatgtccccatccgcctgccgaagcaggcctcccgctcctcagatgcccaggcatccagcaagggctccgctgctggtggaggtggtgctggtgagcaggcatagcagaggccctccagagagactgccctgcacgccatgccttgggccacgttggcagtgtgacaggactgtgattgtgctagatgtacctgcccaagtctgctggtcacatttggcagcaaaatggatttctcctggggagaacaaagttaagggacactgagacctgcccttcagaattcggttcacttgggggcttctgtggtagagactaactggccttctgatgtctttgttcaactgtggccagctgtggcatcagcttcctggagcagtaaatgaagacagagtggaggacacaaatgtacaaaatgcacaagactgatttcttaccacattttagtctttcttgttttaaaaaaaattctttaaaatttatcttgtccgtgtagatactttattcttctggatgtattcagaaattgcatgaatgcccagtgaggggaggtctttcatgcatataaaaaggtaatgtttattgccgggcacagtggcacgtgcctgttaaggcccagctttgtgggaggctaaggcaggaggatcgctggagcttaggagttcgaggctatcgtgtgctgtgatcgcacctgtgaataaccactgcactccagcctgggcaacataggaagacattgtctctaaaaagatacatttttcataaaaggtaatgtttattcaataaaagcagttgcctcaggaaccggaaatatttccctcctcctattttttccccttacagataaggagaaaagcccagaaagttaccagcatgtgaggtcactctgcaagccagggacttgcttggtgccagagccagtggcccaactttgttcatactttctctgctgtaaacttttccaccatacaaggcctacaaatgttttatttctgtccttctgagtttgttggcttcttaactttttcagactttttggaagaaagataagactggaggaggtttatcctgtagcctgttcagttttgccataacctcccattccctgtaccttcccagctgtgtcttaagtggacagataacccctcaccttcacagagattgctcggtgagaattttaactcaaagacaaccaattattgatcccagaaggcccctgagctaatattgtcactgaatttgtacctttaaatcttatggagcctctagcccacccctctgatgaggccaccttagaacctgtttgctcatacagtctaccaagggtcatcacctggatctccagctctcaagggcttagaaactgcagaccggaagggaaggggcagtggtgatggagagagtggaagaccacagctgaccgtaaacaaaggaaaaaggaaaggttatcgcaaacctaaatagaagatgcacagggggaagatactccattgaaaagaaatgaaataagaaagtaatagataaggaaaagaggcaaaggaaattaaactgtagttgaagaagaaaatttaactatattgagttttgtggtggtgatggtcaaaacaacatgacaaactttaccatcttaaccatttttttttttttcccgagacagagcctcactgtgtcgcccaggctggagtgcagcggtgcaatctcagctcactgcaacctccgcctcccgggttcaagcaattctcctgcctcagcctcccgagtagctgggactacaggtctgtgccaccaagcccagctaattttttgtatttttagtagagatggggtttccactgtgttagccaggatggtcttgatctcctgacctcatgatccacccgcctcagcctcccaaagtgctgggattgcaggcatgagccactgcgccgggcccatcttaaccgtttttaagcgtccagaacaggggtgttaactctgtgcacattgttggtcaaaagatctccagaactttttcatcttgtaaaaccacactcaatacccatcaactcccttccccctgcctctgtccatcccctgctctttgcaaccaccattctactttgtaagagtttttctttagataactcacataagagaagccatacagtatttgttgttttgtaactggcctatttcacttagcataatgtcctcaggcttcctccatgttgtggcatgtgtcagaatttccttcccttttaaggctgaataacattccatcatatggatataccacattttctttctttaccttcgatggacatttaggctgcttccatttcttggctattgcaggcaatgctgcaattaacatgggagtgcagatatctcttcaggatcctcatttcaatccctttggatatatacccagaagtgggactgctggatcatatggtagttctatttttaattttttgtggaacactcgtactgttttccatagcagctgcaccattttcattcccaccatcagtgcatgagagttccagttcctccacatcttcaccaactcattatgctgtttttttttttttgatagtttcctcatttactatctttcatctttttgataataaccattctaactggggtaaggtgatatttcattgtggttttgatttgcatttccgtgatgattagtgatgtggagcatctctctgtttgcttattggccatttgcatgccttctttagagaagtctctattcatgtcattagccccttttttaattgggttatttcattttttgttgagtataggagttctttatatactctggatattaacctcttattagatacatggtttgcaaatattttctcccattctgtaggttaccttttcactcttgtttcctttaatgggcagaagttaagtttgatatggtctcatttgcctgcttttgctttcattgtctgtttttggtgtcatatccaagaaatcattgccaaattcagtgtcgtgatgctttttcccggagttttcttctaggagtttttcaggtcttatatttaggttttatcaactacattacgttttatgttgaagaaaaaacactggaatagaattaatgtttaaactgataataaaattttcttcccccacaaaacaaaccaccctgaatataaatactgtaaggccactctgtgtgcttgggaaagttgactcagaggtgtcagatcctagtgaaacgattagattttaaagataaaagaagtcctctcgggccaggagtggtggctcatgcctgtgatcccagcactttgggaggctgaggcaggcagatcacttgaggccaggagtttgagaccagcctggccaacatggcaaagccccatctctactaaaaatacaaaacttagctgggcttggtggtgcacacttgtaatcccagctacttgggaggctgagccatgagaattgcttgaacccaagaggccagggttgcagtgagccaagatcgcaccactgcactccagcctgggcaacagagcaagactgtctcaaaaaaaaaaaaagtcttctcagcctccatgcaggcttacacaagaaagggaaattagatggtgtcagactttttaacagcactaatactaggaagttaaataagttgaataattagaaaacaaaaatgataaatttgaagaaggatggcaacatttttaaactactagaaaacctaattaatgtagaaagcacaaatgcatgtaataaataaggtactagtcatcaaaagaagaaataggttgggctcagtgacacacacctgtaatcctagcgctttgggaggccgaggcaggaagatcacttgagtctgggagtttgagaccagcctggacaacatagggagactccacctgtacaaaaaaatttaaaaatcagctgggtgtggtgttgcatgtctgtggttccagctgctcaggaggctgaggtgggaggattgctgcagtgagccataaatgtgtcactgcactccagcccggccaacaaagtgagaccctgtctcaaataaataatcatctatttttcacacactctggaaatacgtgagaaaatctagctgcaattgtcaattttctgcattcaagcctttaattttaaaaaagtgaattttctaggaaaataattcaccaaaactgaccttaacagagatatataaagttcaaacagacttttttttttttccatagatgaactcaagaaaattgccacagagctgcccccctccctccaaaaaactccaggtccagttgagtttaatagctattagccttaaacactagatacttccagtgttccttaaactttaccagagcataggaaaaaaaaattaaatgatttttatgtagtgagtataatgttgctatcaaaatccagtaggttgtacacacacacacaaaacaatcttgcttaaaaatatcaatggagaaaacaaattatttgcaattgaaatccaccaacacgttaaaaaataacatcatggccgggtgcagtggctcatgcctgtaatcccagcactttggcaggcccaggctggcaaatcacgaggtccagagatcaagaccatcctggccaacatggtgaaaccccgtctctactaaaaatacaaaaattagctgggcgtgatggcacatgcctgtagtcccagctgcttgggaggctgaggcaggagaattgcttgaacccggaaggcggaggttgcagtgagctgagatcgcaccactgcactgcagcctggcgacagagcaagacgctgtctcaaaacaaaacgaaacaaacaaaaacatcgcgaccaaatgggttttattccaggaaatgcaaatgtatgtgtcaaacaccaaaatctcagtggcttaacaccaagtatatttcttatgctgcatgttcagtaaataccagtatggtggagtgtggggagggggtgatgcattgctgtggataattaattactccacaccatcttatgatccttccttctcaacgcaaagcaaggaaagagaacatcaagcgttaagtcctggctcccaaatgtgccacccagaacatatccaccacgagtactcaaatttcactggccaaagcaggtcatttagccatgtttaatttcttagtatttcatttttagttatttagtatttctatttatttatgactgtatgcccttgtgtgtgtgtgtgtgtgtgtgtgtgtgtgtgtgtatggtggtggttctaggaattacaatatatatccttaaaatattacactctggggggtcgcaggcaaaaaaaaattacagtctgccattaattaattctacaatacttcacatacaatgtcagaatgctaccataacagtataactctgtttcccctcggttggtcttttgtggtattgtcatgtattttatctactattatgttgtgaatcccataacagtatgaattttttttatgtagtagtcttctagagaaatgtaaaaagatggtcttggttgggtgtggtggctcacccctgtgatcccagcactttgggaggccaagatgagaggactgcttgagctcaggagttcaagaccaacctgggtaacatagcaagaccctgtctctattaaaaaacaaacaaatgcctggcgtggtggctcatgcctgtaatcccagcactttgggaggctgaggcgggcggatcatgaggtcaagaaatcaagaccatcctggccaacatggtgaaaccccatctctactaaaaatacaaaaattagctgagtgtggtggcacatgcctatagtcccagctactgaggaggctgagacaggagaatctcttgaacccaggaggtggaggttgcagtgagccgagatcgtgtcactgcactccagcctggtgacggagcgagactccatctaaaaaaaaaaaaaaaaaaaaaaaaaaaaaaacaaactcttagctgatggtggtggtgcacgcctgtagtcccagctactcgggaggctgaagcgggagaattgcttgaacctgggaggtcaaggctgcagtgagccatgattgcgccactgcactccagcctgggtgacagaggagcaagaccctgtctcaaaaaaaaaaaaagaaaaaaaaagatggtcttcagcactaacctgcaagttggccctttccagtacaggagagtagggatggagggaggtcatttccttgacgctagtctctcagcttggacattcctctgaggaatgcttaacaggatgagggagggggcttcgcctctggccagtgcccagcttaagtagccttttggaaaagttccagaggacatggagtggggtggggttctgcaggcagccattcctcagtctacacaaccctctggttccacaagaattgggagatgaatttggctgcctgcacttcccagcctgcatcagttttttaaatttttatttatttattttttttttagatggagtctcgctctgtcacctaggctggagtgcagtggtgtgatcttggctcactgcaacctctacctcctgggttcaagcgattctcctgcctcagcctcccgagtagcttggactacaggcgtgtgccaccatgcctggctagttttttgtatttttagtagagacggagtttcaccatgttagccaggatggtcttgatctcctgacctcgtgatccacctgcctcagcctcccaaagtgctgggattacaggcgtgagccaccgcgcccggcctgcatcaggttttgatgagcacgtggccaggagtagggtagtgctgtccagccgatcccctgcccggggaacctcctgtggattgcctggcattgaggttgatcgtatgccctagccaggacaaatttctggaaacccttttgctttagtcatgggggcagggctttacccactgatactccccagcttgcaatgcttcagcaataatctggactgggtttcatcacaagtggtgttaagtctccaaggctttacatttggactattaataaccgtgccctggttatcaatagaaaggggcactccaagagtgtgaactaggtcctcgtgttgatggtgattctgccagcctttgctacaggcattcctttagccattcagagaagatacactcaaatgctacagtatactctaagatatgaataaaatggaccaggatattttcagaaggccccaaaggagaggatgacttgccctcattttcttgacaacttttctcacatctgggcctgtgcaataagaaagctcttacaaaactgctgagacacactgggaaatccagggtataccgatcacatccagccagttctggcactccttggtgtgtgccaagctaggggctatgggaacagggtgagtgggtagatcctttgatgccactccaaagctttctggggagcaccaaaatgacaggaatgcaaaatctctgaaggctcttttctgaattccaagctgactctgcagaagggccaaacttaaagaagcggcccaggctgagcgcagtggctcacacctgtaatcctagcactttgggaggctgaggtgggtggatcgtctgaggtcaggagttcgagaccagcctgatcaacatggtgaaatcccatctctactaaaaaatacaaaaattagccgggcatggtggtgggtgcctgtaattccagctactttggaggctgaggcaggagaatcgcttgaacctgcgggggaggaggttgcagcgagctgagatcacgttacttcactccagcccgtttataagagcgaaactccgtcttgggaggcggggggggggggcatgtgggaagaagccacccgaggagcctggtagggtgatgaaagtgagagcagaggtgtagctcagggccgtgcagcacctcggctttggctctttgcaggctgtagaagcagaatcgtaagacttctcctggcttgtttctttccatttctcgatttgactcctcagcctgctcttctggctccctgctgtctaatggaattccagagcttgaccttgagaatgcagattctcccgattgacaacttctagagaagggaatctcagaaagacaaaggagatgttccttcttccgctgcaagagtggaaaagcagacactctcctgagagcctcataaagctggtgaaagcctgttctgataaagcacccaggagatcattccttccgccccctgctcccaggacaggcacttaggtgagaatgtgtgactcatccagttctgatacctgctgcaaatggtatatgaaacaaaggaatcttttaagccacctgggcttcaaagaaatgtaactgtgtacttttttttttttaatctgcttttaaattggtaaccttgcttaattgcatgttgccctggtaataaccttgcaattgacatctctttttaaaaaatgaaggtctacaatgtctgtattggccagaagagctttgcaagtttctttgttcatctttctcctatgactatgattttcttcgaacaaagagtttgagaggccttgcttcgttttaaattaacaatacatactttgcatatttgacttgagaattgtgtgtatgttatacactactacaaaacaaaccaatttcaataaaaataaaagcacaatccttaaaatcaaagcaaagtgaaacaattgaacctcattatatatcaagttggtggtttactcacacggagaggacttattttaagtgactttaattaggtgactttattttaagtgactttccatggtagttggaaaaaaagaaaccacagtagttgaatgtatatctttagtgggatatattctaagaacaaaaaataaccgcacagtaagaaatcttactgttttcagtaattatgttgttagtaatggcattggtatgattattctgaagatataaatatgtgtgtatatattcaaataatgttaacattgttagcaaccaagattttcagtataacaagatataaaaatataaaataaaaactgaaaaatcatataatcctaaatttgaattgcacgtatccatatgaacacatgatgtattttctctttacaaatattaattaattagcctagaacaacaaacagccaatcaaacaggcaaatcacctgaggtcaggagttcaaaaccagtctgaccaacacagtgaaaccctgtctctactaaaaatacaaaaaattagccaggcgtggtagcaggcgcctgtaatcccagctgctagggagactgaggcaggagaatcgcttgaacctgggaggcagaggttgcggtgagccgagattacaccactacactccagtctaggcgacagagtgagactccatctcaaaaaaaacaaacaacaacaaaacaacaatgacaacaacaataaaaccctcaaaattcaggagtccacttgaaggggctcccgctggcccaggaatgggacaatttgagcatctgaaaaaataacagtgaaaggttgaaacatactaaaatctatgaattcatcatggtcacctttggagaatgctagggaaccagttcatcattctgaaactaggaaataaagggcaaaagcaggcatagatctcacctttcttgtagaaactgtacctcatggcaaccgaacagataataagggaatgtttttctttgtagaggatttctagctaaacaaatgaaaacagaatgatgaaatacctaccaccattttctctttctttcttttttttttttttgagacgcagtctggctctgtcatccagggtggagtgcaatggtgtgatcttggctcactgcagcctctgcctcccgaataccaccattttctagctcctaatgaaataaaggcaagagacaaattcttcatcaatgacagctaaaaaccactcggtgaagagttgatggaaggctgggcacagtggctcatgcctataatcccagcactttaggaggccgaggcaggtggatcacctgaggtcaggagttcgtgaacagcctgccaacatggtgaaaccccgtctatgaaaatacaaaaattagctaggcgtggtggcacaccccagtagtcccagctacttgggaggctgaggcaggagaatcacttggaagttgcagtgagccgagatcgtaccactgcactccagcctgggtgacagacagagttggtctcaaacaaaaaaaaaaaaaaaagaaaagaaagaaaaagagttgatggacatctttataatggatggatattatgtgcctcctggtgtgatacaatacgacatactgcacatcatccatgaagaattcttaggaaaaaatttgaacctgaatgtgatcaagccactaaatttaactgccattttactagaaattctggggacagagaaacatattatgaattagcatcccaacaggaagcagatgggatactcaggttaggagaatgagatgtgaaggcagggtgtaaagatggtgcagggtcctgggaaggtcctcagagaagcctttacaataggaaaggagaggctacccaaatttggaaggagaaagagttgtatagaacagttgtgttgagagggacacagcttcagtcaagaagcacagccaaaccaaggtggccttgccaggagggagacagggaaatacacgccccaactgcattgtcctccctccctcccacacctgccagggctccctattggccaaacccatctgaagccagagggcaagagagcgcagctgatgtaattcacacatggcagtctccaagggcaaattcaaaggtcagagtggagaagggtagttgctaaatgggacaaacgagtacagtctgtcacaaacatgataaataacaccacagggctgcaaacagcaaaatccagaatgcagaaaactctccaggacaaatagcattttccccccaccaaacaaattgcaaagggggaaaagagagggagaagatataaattaaaagaaaatttaggccagtgcggtggttcacgcctgtaatcccaacactttgggaggcgaaggtgggcggatcgcttgagggcagaagtttgagaccaacctggacaacgtggtgaaaccctgtctctaccaaaacatacaaaaaaaaaaaaaaaacaaaaaacaaaactagccaatcgtgatgatgcacacctgtagtcccagctactcaggaggatcagatgggtgggtcgcttgaacctggaaggcagaggttgcagtgagccgagatcatgccactgcactccagcatgggtgacagatcaagacttggccttaaaaaaagagagagagagagagagaaaagaaaaaagaaaatttaaaagcataacaaaaatataaagtgtggaccttgtttggttcctaattctaataagccatgtttgataaaagaaacttctgagcaaatctggcaaatgtggatatttaataatatgaaagaattattgatagtttttaaagatgtggttgtgatttttgtagttttatggagggagagagagtgagtgagcttgtcttatagagatgcatattgaaatgttggcagctggagtcatatttgggatttgctccaaaataggcaaaggcttatagataaaacaagagtgagtgaccgtgtgttgattgtcactgaatatgggggaataggtacacaggggctggttatacttctctgtttttgtgtgtgtttaaaattttccattaaaaaaattaaaaagttgagccaggcacagtgactcatgcctataatcccagcactttgggaggctgaggtgggaggatcccttgagcccaggagtttgagactagcctgggcaatgtagcaaggcccctgtctctacaaaagcaaaaaaaattagtgaggcatggtgacccagctactccggaagctgaggtgggaagattacttgagcctgggagatccaggctgcagtgagcagtgattgtgccactgccctttggcctgggttgcagtgagactgtctcaaaaaataagataaaaagtaatgacactcttgtctagccttgttttgtttatcatatagcaatatttcttggatatcactcagtagcagtgcgtagtgagctgctgcttaaaaaacaaacaaacaaacaaaaacccaggagtctcactattgtttcacaggctggtctcaaactcctgggctcaagcgatcctctcacctcggcctcctgagtagctgggattacaggtggggatgcttcttccttgtctctttataatgtatgtctgtataaattatatgtgtcacaaacacgataacgccatggacatgcaatcagcatatctatgacatatacatataaattttactcaaacggtagcatactatggcttaacaatatgtcttgaagatcactccatgtcaatacaaaccaagcttctgcttttttcccttatcttaatattatttttcatggataatgcattgaaaatctactctccaaccttggctcttctttttttttttttggagatggagtctcactctgtcacctaagctggagtgcagtggcacaatcttggctccctgcaaccttcacctcccaggttcaagcgattctcctgtctcagcctcctgagtagctgggattacaggtgcccactaccatgcccagctaatttttaaatttttttttagtagagatggagtttcaccatgttggccaggctggtctcgatctcttgacctcaagtgatccacctgcctcagcctcccaaagggctgggttttcagatgtgagccactgcgcccggcctccttggctcttttctcttaagaaacggatgagaattgcaaacattttcctatgatggtatttgtcttttaactttgttggggtgtttttccactcagattcttttcgtggacttaaattgcttttgggttttatgtcatactttaaaaggcctcactcactttgagataacaaaaaaaaaatcctacgttttcttttcacatatgtggttttttaaaaatcctttttgggctgggcacggtggctcacgcctgtaatcccagcactttgggaggccgaggcgggcagatcccttgaggtgaggagttcgagaccagcctggtcaatatagtgaaacctcgtctctattaaaaatacaaaaattagccaggtgtgctggcgcgggcctgtagtcccagatatttgggaggctgaggcagaagaatcgcttgaacccgggaggtggaggttgcagtgagccaagatcatgccactgtactctggcctgggtgacagagcaagattccatctcaaaaaaaaaaaatcctttttggtaatacatacacacatataatgatataaaacataaatgtacacccaaacaactgtggctaaatgaacacctgcatgaccaccaccctctgtggtcaagaaatagaatactgctgccaccctagaagcctccagtatgatccatcttccctcattaaaatccactccttcctccttagaagagaccattgtactgatgtcagtggtattctatttcatgttccttatcatgttgctacctcattatgcatccctaaacattattctgttgttgttgttttgagacagagtcttactctgtcagccaggctggagtgcagtggtacaatcatgagtttgaggctcactacagcctcaaactcctggactcaagtgatcctcctaccttagccttctgagtggccagggctgcaggcatgtgccatcatgcccagctaattattttattttttgtagagacaggggcctccttttattacctaggttggtctcaaattcttgggctcaagcaaccctcctgtcttggcctcccaaagctctgggattataggcatgagccactgaacctagcccctaaacattgttttttgtttgtttgtttgtttgtttttgagacggagtctcactctgttgctcagactggagtgcagtgatgcaatctctgcaacgtctgcctctcgggttcaagtgattctcctgtctcagtctcccaagtagctgggattacatgggcatgccaccatgcgcagctaatttttgtgtttttgtgtgtgtgtgtgtgcagatagggtttcaccatgttggccaggctggtctcgaactcctgacctaaggtgatccacccacctcggcctcccaaagtgctgggattagaggtgtgagccactgcacccggccaacattgtttttaagatccattcatgttgtgtgtagctgtggttcattttcattgctttgtagtattttattgtatgcatgtaccataatttatttatccagttggaatttatcctggcaaagatttgcagtaagtctccagctgaatttcttttcaggcgactagccagttgcaccaacaatatttagtgagtaatccgtcttttctccactaatgtaaatgccacttttattatttattaaatgaccttaaatattgtggtctacttccagacttgctcttctgctccattcatctttctatttctgaatttgcaatgaacagtttattattgtcactttataatacactttaagatctggcagagtttgtctcccgcatttctctttctttttcagaacttttcttgatttccctgcatgatctttggaatcagcttgtcaagatccaaaataatcctgttggtatgtttgtttgtatcccattaaaattatagatgaaaagatagaaagatggtatcttttcttcaattgactcctctagccaaaaatggatatgactttttcctttattcaagtctcatggcacataatagcctttgaaagttttagtcatatagttcctgtacattccttgtgaagtaactcattcatttaaacatttgaatagtattctattatatttcattccatggtttatttaatcattctatctttgaatggcatttgaataaatctgtttccaagtttattctgttacatatagcactgcaaagagtatccctgcaaaaatatgtatttggaaatgatgttactataaatgaagttgatggaccaaaggattttaaaaatataaaataataagataataaaggtcatgctaatataaaaataaacaagaaattaaagaacagtgtgttattggtcaagtgtggtggctcacacctgtaatcccagcactttgggaggctgaggcgggtggatcgcttgaggccaggagtttgagaccagcctggccaacatggtgaaacccgtctgtactaaaaacacaaaaagttagccaggcatggtgacacacacctgtaatcccacctactcaggagtctgaggcacgagaatcacttgaacctgagaggtggagattgcagtcaggtaagatcgcatcactgcactccagcctgggtgacagagcaagactctgtctaaaaatatatatataaaaaatatataaaatatatatatataatatatattatatataaaatatatgtaatatataatataatatatatcatatattatatatatagcatgctatcatgtaaaaaaagaatatgaggataaacaaaatataccaaaataagggtaaaatatgtaatatccttgtattaagtagaggatcatagcaggaaagtaaagtgattattatggtactattactattacactggtcttgactgcaaaatcatttcctgcctgtccccaggctggaggtcagaaatggcaaagctgccaccattaactctgttgaggttctacttcagggctttttttcactgaggtggacacctggaaagcctccactacaggcccatagccaggcaagggaatggaagctgcccgagggctccagctgctcactgagttaacatgtgggaggtggaccacagcaactatgtggggaaaccctgtctgcacactgaatcccagcagaatctagcagagccaagagctgagtaacacagagccccaaggacatcatgtgagaccctggatccagcctcacctgaggatgtttcagagcagagttctctaaggcacaagctacaagtgagcatggctgtaacaggcccaagggggcaccagaactggggagaggggcttggtgcctcaaatattgactgctttgggaacggcaggagtgcttgagcggtggacaccggcagcagcagcgaggcccctctagaagcctaagaagggcgctggagcagaaggggacacacagcaggggattggttatctattgctgcataacacccaccccaaaacttagctgcttaaacaacaactattgtatttgctcaggattctgtggctcagcaattcatgctgggctcagctgggcagttcttctgctggtcatgccagagtcactcatatgtctatagtgatacggaacttaacaggggcaggcagtccaaggtggcctcactcacatgtctggggcatcagctgggattcctggaacaggttgagtggctggattattccgtgcatgtagcctctcatccttaaggagtctactccgactttattcacaaggtgacagtgttcctagagaaccaggccctgtgtatacaagcatcccaagctcctgcctgcctcatgtttgctgatggcccactggccagcgcaagtcacatggacaagccccaagtcagtgtgagagggggctatgcataggcgtggatgtcaggaagtgtggtccattggactccattaatgtcatgacgttgccatgtaatatacaatgcatgcttggccctcagcctatgtctaagctcaggtgagaccttccctgggacagcccaagcataagcaagtgagcctggcaggtgagactagagctggtgcaacctgcattaatgaggggattggtgctttgataggattaaaccaggggctagcatagcacagaggagggggcttaaccaatgccagggctttcagaggccctgtggctagaggtgacaaacacagtctctcaaaccaggcagacctgggttcaagtcttcactctgccatttccttcttctgtggtcctgggctagtaactcccctactctgactgtcagtttcttcatctgtgaaatggacctcacagggttgctgtgagaatcaaaggagctcagaagagcttagcctgacacaaagcagcagtctataaatggtggtgctagtgatcagtgtgataagagtggtgataaacatcatggtccctgacattggtgacaggaggcagggtcatggatgttctggatgagcagagagctctggataggtgactaggagtggcctgttagaggagggcagggaagggcatcccaggcagagagagcggtgcatccaaaggcgtggaggtaggattgagaatgatgtgcatgaccaactgcgacaccatcggtgtgtgcagtgtgcctcgaggacgggtgccatggcagaccgcattttcccaagacagatatcgcctatatatcacatgatcgtctgacaatgtggctgttaggagcagaatcatgttcccacaaatatatacgttgaagtccagtacctcagaatgtgactgcatttggagatagggccttaaaagaggtgattggccggacgcagtggctcacacctgtaatcctagcactttgggaggccgaggaaggcagattgcctgagctcaggagttcgagaccagcctgggcaacacggtgaaaccccatctctactaaaatacaaaagaaattagccgggtgtggtggtgtgtgcctgtagtcacagctactcaggaggctgaggcaggagaatcgcttgaacccaggaggtagaagttgcagtgagccgagatcatgccactgcactccagcctagacaacagagcaagactctgtctcgacaaaaaaaaaaaaaaaaaaaaaaaaagaggtgattaagttaaaatgaatgcgttagggtggggctgtaatccagtatgactgtgttcttataagaagaggagacaccaggcatgtgccacacagaggaagaaccatgtgaggacacagtgagaagacagccatctgcaagcccaggagggggtccttaggagaaaccaactctgcccacaccccatcttggatttcttgcctctacaactctgaggaataaacttctgttgcttaagtcaccctgactgtggtcctttgctatggcagccttagcaaacgaatatattgactttgacatccctcccatcaaagggtgtcctatttctcctctccttgaaactcacacttgagcccaaccgccatgctatgaggaagcccgagctagcccagcagccatgctgtgcctgagctagcctagctgccatgttgttcctgagctagcctagcaaccatactaggaagcccaagctagcccagctgccatgctgtgaggaagcccaggctagcccatgctgtgaggaagcccaggctagcccatgctgtgaggaagcctgagctagccttcacggagagaccacacagagagacccttggtaggggttgcagctgacagccatcatcaatacccagacaggtgaatgaagacacctccggatgattccagctcccagctattgagtcacccccccctccacgtccccacccccagctggtgagtcacccccagccaacaagtatttccacctgaggcccgggacatgtggaaaagacaaactatccctgcttcaccttttccaaatttcagacctacagaattcataagcataatgaaatggttgttttacccctctaagttttggagtagttggatacaaagcaatagcatctcccaagggctcttctagatggagcagctacccacagcctggttctgtttttgacgtaacagcgtagaacgcccctctcccgagcactcccgaactttgagagagacctgatactgccacttggtggccaatagaaactatgcaagacccgctgtttcgccctttcttcttccttaagagtttattcacattcattcattcattccacattcataatccctgatggtggtggatcaagtgtagttttaaaaagcatattcgaaaattactttttttaatatgctttcatctttggtcatgaaatttcatttacaagtctacaatcccttacactcttccaaaatccaaaattctctgcaaactcaaagcgtttgcatcagtttataaaagcttactcagtagctaaatctaatccgaactggcttaaggctatttatagtctttcattaacatttcacagtaagattttttttttaatttttttttttgacggagtctcactctgtcgctcaggctggagtgcaatggcacgatttaggctcactgcaacctccacctcccgggttcaagtgattctcctgcctcagcctccccagtagctgggattacagtcacccgccaccacacccagctaatttttgtatttttagtagagactgggtttcaccatgttggccaggctggtctcaaactcctgacctcaggtgatctgcctgcctcggcctcccaaagtgctgggattacaggtgtgagccaccatgcccagcccacagtagaaataataatatttgatttgggggtgctgctctagacccctctaaggatgtcgtaaaatagcagtagttctcaaagtgtggttctgagaccagctgcattggcatcaaatgggaaatggaaatggaaattctcaggccccacttcagacctacggagtgagtgtggcccagccctctgtgctttaacaagccctcttggagattctgactcacgctcacatatgagagtcactgatatagactctatgcacccaccacattgcatttataaaattcaaaaaattgtgaaattcctaagcacatgtagtcccatgctttatgaaaaaggattgctttcagacctgtattttggaatgtcaagtaatattaagggaagccatgagattttcatgtctaaaaaggggggaaggggccaagcgtgggggctcacgcctgtattcccagcactttgggaggccgaggcgggtggatcacctgaggtcgggagttcaagaccagcctgaccaacatggagaaaccccatctctactaaaaatacaaaattagccagccatggtggcgcatgcctgtaatcccagttactcaggaggctgaggcaggagaattgcttgaacccgggaggaggagcttgcagtgagccgagattgtgccattgcactccagcctgggcaacaagagcaaaactctgcctcaaaaaaaaaaagggggggcagtggggaaggagttccttgtaggaatggagaaagggtgtgattaataacaataaaagctaacttttgctgagttatttataacctatcaggcactgcgccaagtgcctatgcttatctagtccacataatgcacctaggagatagttacttttatcatacccattttatgaatggggaaactgaggcaagtggtgtgagcacctaccaaagcctgaagaaggtcagcagtagaagctgtggccttcagtagagggacacagccaactcacatggcctcacttctgccctcttatctcctacaagaagccagaagacaagggaattcctatggtgtcatccacagtagtgcagagcaagatgaagtatgctactcaggcctccaaatttccctccaaaacaactgcaccagcgtttggttcctcccaccccaatgggttccacttacacagtcttaggtctgtagggctagtgaagacagccagcctatcatttattatgcctctagtgcaaatctgggtatcacaaatgcatgctattgtggttataaaatataaaagtatcagccgggcccagtggctcatgcctgtaatcccagcactttgggaggctgagacgggtggatcacctgaggtcgggagttcgagaccagcctggccaacatggtgaaaccccgtctttactaaaaatacaaaaaaaaaattagctggacatggtggtgggtgcctgtaatcgcagctactcaggaggctgaggcaagagaatcgcttgaacccaggagttgaaggttgcagtgagccgatattgtgcccttgcactccagcctgggcaacaagagtgaaactccatctcaaaagtaaataaataaataaataaatataaaagtatcacactgtaagtgttcatttgcagcttgcattttttcccaactcattttgttttttcagatttatctatgttgatgcaggcagctttatttctgttcattctctctgttgtttagaattctgcgatattaaagcactcctgaatccatttatccattccccctttggtaggcatttaggatgttgctggccttttgcagataaaggcctaatgaatatctttagacatgtcttctacacaggtgggaggttttctcctagctggatgttcctaaatgtggagctgctgtattactggacgcgagtacccaactttcccaaataatgccaaatttccctccaaaacgattgcaccagggtttggttcctcctaccccatggggttccacttacacagtcttagcccaccgcggtattgagagactattttatttatatttattttgcctttccgatggatgtgacctctacctcctatctgttttatttacatttccctgataattcagaaatggagcatctcttcaacccatctgtcatgtggggataaacattttgcctttccacttcaggctttgcctatgtacagttgacccttaggcaacatgggtttgaagtgcacaggttcacttaaacacagttttgtttttgtttttttttcaataaatacagtaggctgcccatatggatgggttctgcatctgcaacccaatgcggatggaagataccatatttgccggaatcctgcaggactcctgaaattttacgcactgattttgggaaccagagtcctctgcagataccgagggatgacatatcttccaagcatagatttctagaatttcaaaagaccttccctctcttattccaggcagtaacacatgaaaagcgcttcggctttcaggctgcctcctgggctgtgggtgttccaggctcaattttgccactcaggcctgaggaacaattttgtttgctgtcgctggcatctgtccttccccagaggcaaagagtgacaatcgcgagatgggtgagagctgagggcaaccacagtagcagcgcaacaaaacaaatgcagaagggaaggaaacctaacccacatttgtaatttccaaaatattgtcttgctgcattttcaagctctgtttattaaagccctgatgtatgccaggagtatatttctctatcctccaaacacttccaccagcctcctaaagcagggtcacttcatccctacaacaaattcttgctgccaggcacagtggcccacacctgtaatcccagcactttggggggtccaagcaggagggcttgaggctgagttagaagtcagcctgggcaacatagtgagaccccatctctacaaaaaaattttgttttaattagccaggtggctgggggtggtggctcatgcctgtaatcccagaactttgggaggccgaggctggaagatcacttgaggccaggagttcgagaccaccttggccaacatgacaaaaccccgtctctactaaaaatacaaaaattggccgggcatggtggtgcgcacctatagtcccagctacttgggaggctgaagcatgagaattgcttgaacctgagaggtggagattgcagtgaactgagatcatgccattgcatgccagcctgggcgacaaagcaagtctctgccttaaaaaaaaaaaattgccaggtgtggtgatggcacctgtagtcccagctacttgggaggctgaggcaagaaggtcactgaagcccaggagttcaaggctacagtgaactatgatgctatcgtggcactactgcactccagcccagatgacagagtgagaccctatctctaaaaagtaaaataaaataaataaaaatgtccttgctcttcctatatgccaggctatgttaggcactgggaatccgtgttaagcaaaaaggcctggtgtctgatcagagcgcagggtggcactcactggatcaatgtcctggggctcccataacaaaatactgcagacttggtggctcagacaatttcctcacatttctgggggttaggagtctgagatcaaggtgtcagcagtgctgccttctttttctctctccttggcttgtaggtgctgtcttcctcctgtgtcttcacagtgtcttttatctgcctccaaatctcctctaataaagacattggtcctactggattagggtctacccatatgaactcatttgaccttagtcaccttcttttattcttttttattcttttttttttttttttctgagatggactctctctctgtcgcccaggctgaagtgcagtggcacgatcttggctcaccgcaatctccacctcccaggttcaagtgattctcctgcctcaggttcctgaatagctgggattaccggaatctgccaccatgcctggctaatttttgcattttttagtagagatggggttatgccatgttggccaggttggtcttgaactcctgacctcaagtgatctgcctgcctcagcctccctaagtgctgggaatacaggtgtgagccaccacacccagctccttagtcatcttatgaaagaccctatctctgtatgcagtctcatgctgaaatactgggggttaggacttcaacataggaatttgggagtggtgggactcagttcagcttataacactgtctaatgggagaagcaggattaatattcaatgccacaacgatgtacaaaatgacaactgtggtccctggggttatgagagctactaccagggggtttggctgagtgggctctaggaaaccttccctgagaaagtgatggttgagctgagacctgaaagaggttgggggctaagcagagggagggaacagcaggccaggtgtagggacaagatatgctgcagggctgggaataccccagtaggcacatgaagaccaaaggcattaagcggcacaggttgctgaggggggacttctgggcactatgttggagatggtggcaacttaccccaggtaaaaatcaccagagcactcttttaaaaatacagatcccaggcctcatccaggtctgctgaatcagaatggccaaggggaagggcccgagaatctgcattccctcacaatttttcttattttgaaaaatatcaaatctagagaaatggaaagaaaagtacaaggaacacctgaacccccttcacctagactcaccagttgttaacattttggctcatttttgctttctctctctccctccctcactctctcctcaccaagcatctcctaaaaataggggcctaggccaggtgtggtggctcacacctatcatcccagcactttgggaggccgatgcaggaggattgcttgagcccaggagttcaagaccagcctgggcaacatagggagatcctgtctgtataaaattatttttaaattagccagctgtgggccaggcatagtggctcatacttgtaatcccagcactttgggaggccgaggcggacggatcacaaggtcaggagatcaagaccattctggctatcatggtgaaaccctgtctctgctaaaaatacaaaaaatgagccgggcatggtggcacgtgcctgtagtcccagctacttcagaggctgaggcaggagaatcgcttgaacctgggaggcagaggttgcagtgagccgagatcgccccactgcactccagcctgggcaacagggcaagactctgtctcaaaaaaaaaaaaaaaaaaaaaaaattagctcccaggtacgtgggaggctgaggtgggaggattgcttcagtccgggaggttgaggctgcagggagttgtgatagcaccactgccttccagtctgggtgacagagtgagaccctgtctcaaaaaacaaacaacaaaaaaggaccttttcctccataaccacgaccagaacaccgttgtcatatttaagaagagtaatgtcaatccagtaatgtcatctaatgtacagataatatttaaattccctgtggtttacaacatttctttcatagctatttacttgttcagtccaagagccaatcaaggtgcacgcattatgcactttttattgtgtccttttaatctctttcaatctggaataagtccctgccactataaaaaatgatattaacttttaaaaagagagtctaggcttttagaatgccccacattctagatttgtcttaattttcctcatgattaaaatcaggttaagtatttttggcaagaatatgacatagaagatgttgagtatatcttattgcatcacagtgggggcgaacaatgtcaggttgtcccactatggtgatgctgtgtgatctcgcgtttaaggcagagaccactggagttctctgatgtaaaggtacattttccccttttacctagtaaatgatctgtggcatgatgttttgaagagtgtgactgttctgttacccaataccttttttctcaatggctgtagcagctgttcatggttgttgttccctcaatcaattattatattggtgggtgcaaaaaggaatctgcatctttctttccttccttccttccttccttccttccttccttccttccttccttccttccttcctttctttctttctttctccttccttccttccttccttccttccttctttctttctttctttctttctctctctctctctttctttctttctttcattttgagatagagtcttgccctgttgcccaggctggagtgcaatggtgcgatcttggctctctgtaacttccacctcccagattcaagcaattctcctgcctcagcctcccgagtagctggggttacaggcgtgtgccactatgcctggctactttttgtatttttagtagagatggagttttgtcatgttggccaggctggtctcaaactcctgacctaaggtgatccacccgtcttgacctcccaaagtgctgggattacaggtgtgagccactgcacccggctggaatctgcatttttaataagtgcctcaggtgacttttctttgcctggaattttggaaaccccatttaagtcaatataaggaatacaggagaatgaggcattgctaccaaggcagctgaaggcattagctaaagcctattattcattagaatctgctaaaatgcatattctgaggcccgtacaccaaagaatgagaaacgggtgcaaaggacaggcccaggaaggaggattttaatactatctctcccctaccatcctgccaaccgtggatatggtttgtttgttgccaccaaaattcatgttaaaatttgaccttcagaatgaaggtttggggatgtggcacctagtgggagatgtttgagtaatagtggcagatctctcaggaataacttggtgctgttctcccagtagtgagtgagttctggctctggggagactggaatggttgttgcaggaacggattatttcccacaagagtgggttgtcataaagccagcacagtcctcaggtttcccctttttgcacatgtctgtttcccttttgaccttctcccttctctaccatgttgcgatagaggaaaacccttgccagaagcctgggccatgcccttgaacttctcagcctgcagaaccgtgagctaaataaacctcttttctttataaactacccagtctcaggtactctcttatagccacagaaaatggactaaactccctctcccatttcctacccactttgtggtcaccaaaacttgtgaaacactgacttaggtggtgattcttaatcctggctaagttaagtgaagttgcattttcaacatgccttgggagttcttttgatctgtatgtatgtttaaaaataaacctccagagattttgattcaaagggtctggggtagaacccagccatcagaaaaatttaaaacctcttagtgattccaaagtaccaccaagactgagagccactgcacaagattctccataaattgaatataaaaatgaaagccagctgggcacggtggctcacacctgtactcccagcactttggaaggccgaggcaggtgcatcatgaggtcaggagatcaagaccatcctggctaacactgtgaaactccatctctactaaaaatacaaaaaattagctgggcgtggtggcaggcacctgtagtcccagctactcgggaggctgaggcaggagaattgcttgaacccaggaggcggaggttgcagtaagcaaagattgtgccactgcactccagcctgggcgacagagcgagcgtctttctcaaaaaaaaaaaaaaaaaaaaaaattgaaaaccagtctatcccactcttcgttacccctatcctcacagcatcacaggttgagctcaccactagccttaaatgcctggggctccttccacctacttatggggctcctactgtgtgcaaacagctcttggggagcttacaaaagaggtaaaagtcacttcccacaaaagcatgaggacgtgggaaaaaaccacacatacaaacacttataagtattgtacaatcagaattgtacagaccaggaaaccgacattcagaagaggaaatgaccgcccagcgagttcatgccagagccagaactcttacctgggatgcctttctccttcttggctcatttttacttgaacccaagttgaaccctctgcacttcctgctcttctgttggttgggcctggcctggagctatcatcttcatcatcaggagtagcagcatggggacaagggcagcctatcaaggcttattctgggtctagcattagactaagtatctgttgaatgaatgaatgaatgtagccagcctagcacctgcccacaggctgacattaagaaccacaagttcaggccaggtgcagtggctcatgcctgtaattccagcaagactgtttgagctcaggagtttaataccagcctgggcaacatagcaagagctcatctgcactaaaagtaaaaataattgagtgaaactcggtctcaaaaaaaaaaaattagctgggcctagtggcatgcgactgtagtcccagctactcagaggctgagatgggaggatcacttgagtgccagaggctgcagtgagctatgctcatgccattgcactccagcctgggtgacagagtgagactctgtctcagaaaacaaaaacaaaaacaaaaacctttgttcaggctgggtgtggttgctcacgcctataatcccagcactttgggcggaccacttgaggccaggagcttgagaccagcctggccaacactgggaaaccctgtctctattaaaaatacaaaaattagccgggcatgatggtgggtgcctgtaatacaagctactcaggaggctgaggcaggagaatcacttgaacccaggaggcagaggttgcagtgagccaagatcgtaccactgcactccagcctgggtgagagactgagactctgtctcaaaaaacaaacaaacaaaagaccttggttcagataacctctagaatgaatccctttaaacactgaaattagttcatttttcacagactcaggaatctctagaccttgcctcatagcaactatataattcacccaaattctaccttctgtataatttttttttttttgagacggagtctcgctctgtcgcccaggctggagtgcagtggcgcaatctctgctcactgcaagctccgcctcccgggttcacgccattctcctgcctcagcctcacgactagctgggactacaggcgcccgccatcatgcccggctaattttttgtatttttagtagagacggggtttcaccgtgttagacaggatggtctcgatctcctgacctcgtgatctgcctgcctcagcctcctaaagtgctggtattacaggtgtgagccaccgcgcgcggcctaccttctgtataatttctatggaactatgaatttacttagttgctgttgaccggttgacctaaagttatgttgacatttaactctatatttttaaacatcagtgtttagattttgtatgttggagcccatttatttatttggcggccctcaaacattttcccatagcctcgtagaatattcagtggccttggactgtcccttaatgtcttactacagatggtaccacagatgacctccaaaataaaggaagagactttcctgcctgtggacaggagagagaggtgtggaggatgagagcatagtttaacttttttttttgaaaaactttattgagatataatccacatgccatacaattcactggcttataagtatataattcagtggtttttaatatatccatagttgcgtgatcatcaccacaatcaattttaaaaatttttatcacctccaaaagaaaaactggtactctttttgagtcaccccccatttgcctccaataaccccctcccagctctagacaatcaccaatctgacttctgtctctatagatcagcctattctggacatttcctataaatacaatcatataatatgtgtatggccttggaactggcttctttcactcagcacaaggttttcaaggttcattcacgttgtggcatgtgcttcattcattttgattgccaagtaatagtggattgtaccgtgttttatttatccattatcatttgatggatatttggattgtttccacttttttttttttttttttttttgagacggagtctcgctctgtcgcccaggctggagtgcagtggcgggatctcggctcactgcaagctccgcctcccgtgttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttgtttccactttttagctgttgtgaataatgctactatgaacatttgtgtacaaatttttgtgtatgtatgcttttatttctcctgagtatatacctaggagtagaattgctgggtcatctggcaactctatgttttaaattttgaggaaatgccatactggttttcaaagcagcggcaccattttacatttccaccagcaatgtatgaaggatccaatttctccatatccttaccaatgctggttattgcctatcttttttattataaccatcttagtgggtatgaagtggtatctcattgtggctttgcatttccttcattgctaatgatgttgagcatcttggccatgtgtatatctatcttctttgaagaaatgtctatccagatcccttggcctttttttttttttttttttttttttttttttttgagactgggtctcgctctgtcgcccaggctggagtgcagtggtgtgatcttggttcaccgcaacctctgcctcccaggttcaaacaatcctcccacctcagcctccccagtagctgggactacaggcccatgccatcatgcccagttaactttttgtatttttagtagagtcagggttttgccatgttgcccaggctccttgcccattttttattatttgtctctttattatagagttgtaagagttccttatatattctagatataagtcccttaccaggaatatgatttgcaaatatttcctcccgttctgtgggatattgtattattttgccaaggctgccataacataatactatagactgggtggcttaaacaacagaaattggctgggtgcggtggctcacacctgtaatcccagcactttgggaggccgaggtgggtggatcacttgaggtcaggagtttgagaccagcctggccaacatggtgaaacccttactctactaaaaatacaaaaattagccgagcgtgggggcatgcacctgtaatcccagcttctcaggaggctgaggcaggagaatcgcttgaacctgggaggtggaggttgcagtaagccaagatcgtgccactgcactccaccctgggcagcagagtgaaactctatgtcaaaaaaacaaaacaaaacaaacccccagaaatttattcctcacaattctgaaggctacaattctgagatcaaggtgttggcaggtctggtcccccagccctgagtcctctctccttggtttgtaattaaccttcttctccctgtgccttcctctggtctttcctctgtgtggcgcatctctagtgtctcttcttatgaggacaccagtcattggatgagggccccatccaagggcctcagtttaagatgatcacctctttaaagaccttatctccatccacagttacattctgaggttctgagactgtaaccagtacagttcagcatatgaatgggggtgagggggcacacaattcagcttataacagttattttttcactctctttttgttctttttatgtttaatttttttttttttttttttttagagacagggtcttgctctgtcacccaggcgggagtacagtagcaccatcatagctcactgcagccttgaactcctaggcaaaagcaatcctcttaaatagctaggactacaatcatgaaccactacgtctgcctaattttaaaagaatttgtagagacagagtttcactatgttgccctggctggtcttgagctcctggcctcaagtaatcctcctatctccacctcccaaaatgctgggattataggtgtgagccaccaggcccagccataacttttcactttcttgatgatacccctgaaagcacaaaagtttttaatttatctatttttttttcttttgttgcttgtgctaatatctaagcaactactgtttaatccaaagtcatgaagatttaggcttatgttttcttcagagagttttatagttttagctcttacatttagatctatatgttgcatatagtatgaagcagggatccaaattcattcttttgcatgtggatatccagttgtcccagcaccattttttgaaaacactattctttccccattaaattgtcttggcactcttgttgaaaatcaattggcagtaagtgtaagggcttctgtctggactctcagttttattccattggtctgtatgcccatccttatacccgtaccaccctgccttgatgactgaagtttcctagtaagttttgaaatcaggacttgtgagtcccccaacttattctgaatttactttaacttttgataccgaacacagtgtgagaggtgaatgaacagcatgacattggagttgggagccccctccctccaaaggccttattttaggaacacaggccccaagtgccacacaagccttggagagatgggttcccatcctctcagcccatggctcttcattatcaatcaatggaaacattcttcggagaacaatgattcccttgggttattttaaacatggctttaagtcttccccacatgctctactgtctaattgcttttcctgaaacagtgtcattcacaactggattattaatgaactgagagggagccagggagccaatgaagggggcttacagagttcctggagagggcctgggggcctggaacaagttcaacccacagattttctctcccccaagaaaggtgactgagcaaacagaaaatcactaaactcaggtgatgctggtggcctcaaaagaatattgccagtgaaaaaaaaaggattcgggcgagttcctcaaacatgacagctgagaatcaaattaactgggtaccatccccaaactccccaaacttaaactctgaatttccccagctggctggccctggggtgcctagggctctcatctgtaggccgggaaagctcaggaaacaaggcctttgtggagaagagaaacctattgttctaaggccagggttcagcaaatgtggattccagagaatgtttggggaggttttctctgctttgtttatgaactttcttttctcttcctggggtggtgatggtggggggtgactctcagcaacttaaatagttaaacccattgtgttgtaaagaaaggctggtgcacagagtgcagaggccttcagccccagaaagaggcttgaatgaggtgacagaagccaccgggtatgttttgctttttatttttagcgttaaatctcagggaagcagcccctatcttcatcctgcacatctcaaagggcgtcagacgtcagcagaggtacgaccacttccttcctccagcgcttcacctcccttctttccagaaagaggaaatgatgcgagtccacaccgcaggccacagcccccatgtctcggccccagcagctgggggacctggccccacagatctgtccccagcgcaaggccagggccggcccctggacctcctgggaagccttcagactcaggccgcgcaggccttcaagctaggaaccctgagttcctggccctggcattcattctgtgtgaccttgagcaggttaccactcctctctgggcttcaggattcccgtctgtcaaatgggagcagggataccgtccttggcttccctctttccatggtcggggtgggggttaggaaaactattttggaggagggggcagcgttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgtcgccgctggagcagctgcggctcggggacccacagacacagccggggtcgggagccgcccggggcagggctcgggagagcgggtgagttccccggcggcgccaccaccctccttgcgctctgcggcttcgcagggcgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctgcggccgtcgtagaccgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcgcgtggcggggcttggtcctggcgggcagcggcagggcgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcccggcctccagcttcactggagatgctgatgatgcagctcccagcccttggaggataattgagcctgggagagctttgaatctggccctcctgagaccccagggctgcgccgctgccgcgcgccaggcctgggtcccggtgctcccgggcacctcaggagcggagggagagggatgtggcttcatcagcgcttctaggaaccgaaaaccgagctgcctgcgcgcccatgtgattgcatttcacataaagggcccctgttttcactgtcagaagagccccccagctctccgcggctctggacaccaggtgccgcctctgaatcaccctctgtggaggacccggggcccggaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctactcgtgggcaaggtacttggcttctggagtctcaactgcctctaagatacggggctaacagccgccaggctgtggggagatgagggagaggctgggtgcagcagagcgggaggatgaacactccttggccaatactggccgccctcgggattggctttgagtggggcgtgtctctcttagacaggtgcagaagtggagccctggtgggtggttctgcaggggctgggggagtttccacatcttcctcccccagctctgtcataaaaagccagcttgcaggaggccggtgggggccagcaaatccttccagccggctgcctgctcacacggcccttcccacacaaatctcccatgcccttctctcccacctgtcacccaaatcccatcttcctggctgagtccccaggatgctgggggcaagatgtcaaccaggccaccctggactgtcaactctgtgcctacttgtctactggggtctacctaacagtgttcccctgtcctggaaccttcctggctccagctcttcccagcctctgtaatgtcttctttcccctcttttggtctcctaccaccgtgacactcattagtggctctgtggttcatgtgtcaagggccccgtgccatctgtgctctccagatcatccatggcctagaaagacacggtaggcaaggccctgtgcccactcagactttgctctccctggtaattgacggagtggaggttaaattctaatctagctgttaagtcatttcaggagcttgagccacagggctaagaggatactgatgtaggcaggtggtttttccttaaagccagaacctttctcctttctgcagagcccatttgagccctttggaaactaggcctatgtgtgatggcctcacagaatcctcacaaccccgtgaagtaggcattactgattcccattttgcagatgggaaaactggggctcagctcctctcaaaaccagctccatgccccaagtgtagcaacagaggctgcagccaacctggtttaggagaaggcagaaggcacatacctgaattcaggtgctgtgcttggactcttgggaccccatccccccaacctttccctcccctctcccaacctagccaccacccctcctgcacccaggactcttgtcacatttgttgaccaggaggtcccaactggcactcttccagcagagaccaggaaaaccttcactgtcctgagtgcatcttagcaattgggcttcaagaagggctcggacaagcctgcctcttacagaaagctacgagtatgaagagtgagggagccagagaggtctaattttaattagggatctatacctaaaagctctgtgaccctgtatacatgacttaatctctctgagtctggttttctcatttgtaaaataggtatcacagtaatgcctactttgtgggattgtaaggattccatgagaccattaacacatagaaagtgctcagtactagggtggagcatagtggctcacacctgtaatcccagcagtttgggaggccaaggcgggaggatcactagacgtcaggagttcgagaccagctggccaacatggtgaaaccccatctctactaaaaatacaaaaattagtgcagcatggtggcgcatgcctgtagtcctagctacttgggaggctgaggcacgagaattgcttgaacccgggagcaggaggttgcaatgagccgagatcacatgactgcactccagcctgggtgacagagcgagactccatctcaaaaagaaaaagaaaaaaaaaagtgctcagtacagcatctggtgtgggtaggaatgcaggaaatgatcattgtcaccatcactactatttcctcctttgtgttggactctcaaaggtcccacctcctccagtgctagggtggggagtgagtgcgaccctgtctcttctgcctgtagccatcaggacggggaaagcctctcagcctgtctcctggggcgggggtgggggctcactcctgggaacttgagtctagcaccagcttttccccggggagtctgtgagcagccacttagcctttctcagctgactgccattttccaggattcattgattcattcaaaagacgtttattccatcccagcccttgtgcttagcaagggatttcaagatgaatgaggcagctctcagagttctccctctatggggagaggcaggcctggagacagataatgaggacactgtgggataaaggctgcaacagcaagaagagagagtgacgagcagatccacatggctcaggctgacccaggtctgaatcttgaagctgccaccttgtagctgggtgaggatggacagaggccttacctctcaagcagataagccacctccctaagatgatgatgtgaggagagaagtgagacactgtggataaaaaacctagcttggaccaggtgcggtggctcatgcctgtaatcccagcaatttgggaggcagaggtgggcagactgattgactccaggagttcgagactagcctgggcaatatggcaaaaccccgtctctacaaaaaatacaaaaaattagccaggcatggtggtgtgcacctgtagtcccagctacttggaaggctgaggtgggagaatcacctgaacgggggaagtggaggctcctgtgagccatgattgcgtgcacctctgcactctagcctgggcaacagagtaagaccttgtttcgaaaaaaaaaaaaaaaaaaaaacaaaaccaaaaaacttaaaaacccagcttgggctttctagatattaataagtgctcacagatgttcgttgctattattagtctattattgccaataacaggtgggcaaaagttgctgtgggagcatgttgagcccttcagtgacagttttccaggtggtagggcagccctagccgggagaacagcatgtgcagaggcaccgaggcttaaaagtgctggatgtttttggagagcagtgggaggagttgctgatggagcagagtcatgagaaagtttgatggaggcagaagcaaggccagggaggtagcagaggctatcctgccgggagccccgaaggattaaacactcactgacccgaggcagtccctctgcaccttccttggagggtggttctctagtgagggttgtccaggaaacttcaggattaacttttgcatgggaggaagggctggtctctgctcaactatccatacattcaccatccttccctcttcattccacccaggaagcacgaagaagaagaggtccactccctcttcctgagatgcttttcccacctctgcacttgtttctctcttcctgggactcagtttctcacctgagagaagagggtagaagtggaggaagcgtcatgacctgactcactgattgatcatgatatagcaccaagtgcatttctggatgctggtcactgtcaaaggtctttacttgcatcgccattgaattctcataccaatccgttgaaatgaatgcacttatcccccactgcacagagggagaaaccgaggcacagagggtgaggcaatttgctaaagggcatgcagcttgtaagtgacaggaactcacgtcttggggggcatctcaaagttgccatgtgctatccttcaccaccttcttcacacactttgtaaatctaaggctgactgcagaatatctggcctcttttgctttgtgtacctttgggcgctgggcagtaggcattttggagatgggtcacagtggggtgtgctctgggtatgtaacctgactttggggaaattcctgggtgcagacgctttgtggggaggtgttcttggatgtctcagaatctagaatggcattccttcgcccacagatgtgccttgatgcaggcaatgtgcagcttgattgatgtggcaagatggtggctgagccccacggtggccccaggaaggaatgaatgaatcttttaggatggctgatcagagcatcacatgaccacagaccctccctgtttcagaggacatccaaacacaggcttacatttccttttacatgggggcaaagtttggggccagggttcaaatgctggctctgcctccactggctttggggcctagggaaattttttcacttccttgaaccttaatttcttcatctggaaataaagatgaagaaataagttgctaattttagcatcttcaataagttgctaaatagtaactcacaaacacaattctgaattgtcataaggatttgtaatcatatggaaaatgcttggcttccaagctgtagataatattgatgtaatatccagcagatttttctctgcagtacttataattgtgattatatggttatatgtgagcattactcttttagtcttctgtttcatccactagacctgtggttctcaacttggggcagtttgaccctccccaggggatatttggcaatgtctaaagacgtttttggttgttacaacttttcgggggatagtgggggagaggagctactgacatccagtgagtagacaccaggggtgctgctaaatatcctgtggtgcacaggagagcacccccacaacagaaaatgatctgatcccaaatatcaatagtgctgaggttaagaaagactacactggacgatgagccccataaggtccgtgactgtgtccaattcattcagctgtgtgtctccagttggccagcgtgatcagcatgatgtccagcacacaggagacaatcaatatgcattaaaggaatgaatgaggacttggaaggccttatgtcccctggagtcccaggggtttagcttgtggaacattttgaataggcagaagagatttagatgaacttgaatgatgaacagccaattagtaactcaggccaaagacattcagaccgagctctctgttttccttcccaagcaggtgcttgggggcccagattatctgaattgttcctgccatcaccactgcattttacccatgtagatacaggacccgtctttatctggaaagtaggctggggcagaggagcataggtgctgtcagctgggcccttgggatttgccaagctggggcacagctgcttgtcagcttcctgttttgtccctttctagtggaatgaaggaaacccactgaatggctattttccactgacatttacagcaatgtgataggccttggattaatgaggtcaaactgcagtgtgaaatctgcctgataacttgaagcttggccaacgggaagacatcgcttgttttctttggaccgtttgatgtccctggatggctttaggcaggaaagcaggggtctcaattctgtacgaaagaggagggtgttttacttcctggaattatagaggccagaggtgtctctttttcaatttattgggaaggtttattttaatatggacttagaaataaataacttattaaagtgaaggttcacctggagccttaggctggctgctaagtgtgagtctgggctgttgaagggactgtgctgttcttctgggtctctgtaggagtttgaaggagaagactggccccaaagggtgtttgaacaggttagatgtgcccattggttagaacttacttggatagggagaagggatctagggcgtatccacaaacttgcatatggatcccctttggtttcctgctaaaatgcagaaactgactcagtagggctgggtatggagttttctgcatttctaccaagctcccagggggtgtcaagctgctagtctgtgaactgcactttgagaagcaagggtatgggagaccccaagtctacaggtgagggttccctggtgcaaaccgcttaagcatgaaagcaaatgcagcctgttgtgcctgttcacacagccatctgctgtgctggctggcttgcggagtcacagatgttcactgtgccccttctctgtgtgcccaggcctgggaccagacttgacaaagacgatgcttggtctcaaggagcaactcagacagccagaatgtcagctagaatgatgagctttgagtactttcaaaaacatgtatccaggtacatggtgttcctgggtcatctggtcacctgggacttgtgagaagtacagatgcctgggccttagcccagtccacctgtgttagaatcagccaatatagggccctgaaagtctgtattttctcaaagtgtgccaggtgattctgattcacagccagactgatggaagggaaggtgggaggaagaactgccagtacatgcaggttaattgctcagcaggacctatgtaaggttgtagagttgtgtattgctgatgggcacagtggcactcggctaaaggagaggctgaaatctagcctgtggatccacttgccaagctctgcaccctgcagggttgcatctgcttagagggacgggcacctttttcttaatattcatcataatcacttggtacttattatgagccaggtgctgtctacttaactcctttagtcctcctaacaactctaaggggtgacatcatcatcatcatcattattattattattattattattattattattattattattattttgagacacagtctcactctgtcgtccaggctggagggcagtggtgccatctcggctcacggcaacttctgcttcccgggttcaagtgattctcctgcctcagcctcctgagtagctgagattacaggcacccgccaccactcctggctacattttgtatttttagtagagaaggggtttcaccatgttggccaggctggtctcaaactcctgacctcaagtgatccacccggctcggcctcccagggtgttgggattacaggcatgagccactgtgtctggccaggtgtgactttagtgctactctgattttactgttcaggaaagtgaagcagagaggttcaatgtcttactcaaggtcacacagccagtaaatggaaaagtcaggattccatttcaggacatccggcttcaaagtccttgtactgaatcattacactctctggccctttctttgcataaaaatgctgtcttctctttatggggctatccctactctgagggagtaccttttttcttgtccttccttcagaggggggaaggctagcaatgaccttggctggctttagagtcaggtacgggtttgattcctacctccagcacctactgcaaccttgagtaagttacatgtgtgtatttgctgagccacaatttccccatatgtaaaacaggaataataatagtataatataaattgatatgattaggcatttagcctctgcttggcaggtaggaggtacctgatacatgccaactattcttatggcattattatcattagagttagtccctaggagtattcaggagctagggaaataggtgagcaaagcactgtgtcattatgtccccaggagctgggtcattcattttgttcactaggttacttatggccattacttacctgggcatccctagtctcctccgcttcttggccccagagtctgtgccagcctggagagttctcagaatgtcttagttcagactcttagtcagaactgcctttgtttcctcacatccaagaacaagtaaaacatacaaattttgacacttattctctttaggtctcttgactctttttggtgactttctctgtctcctgttttctttctggaactattgctgtcgttggctatcccatggactggatagagaggaaatgttgccttataaacattgccaattaccttataaaaatatagggaagattttcaccaaaatgtcattcattttttttcttttatatataaacttaagcttttgttttcctatggctgtatgtcatgctttttaattacacaaagtatataagtgtatcataagtaaactttccccatcttctcagccactcatcccttttccccggaataaatctataaatgttttatgtatttttccataaatttcatatgcatatataaacccatattcatttacatgtttatccatttttctttttaacacaactatacaaaactctcctgagatcttctttttcagctaatttatctgagcacatgccaacacacagatatacctggatctttaaggctatctgatagtccagtgataaaaatgtaccatcatttgttttctagtttcttgatgatggctaagatagtttccagtttttttcctcctacaaatgtataatgttgcaacatccttgtttgaacagtgtatatatctttgtatactctacatactgatgattttattcataaggaaaattcctggcagtttcaactgtgatagacattgctaacctgttctccaaagaggctgaaccaatttctgtttcctcaacagtgtatgactgtttcccccatctattctccagcactgaggattaagtaactttcatttttgtcagtctgacagatataaagcagaacatttctgcataaggttctacagtaatttttagattttatgaccctttggattatgcctacataatgatgatcaaatattcagaaactacattgtacctggccttaggcttggaattggatacaaaattaaatgaaaccagcttttgccctcaggttgatcccatctcctggagttggcagacaaatgaacaaataaaatgagagcaaaactgtatggttcacattgtgctagagaaatgcataagcttagctaacttttgtttgataaactctatattcattaatatcacaaatgaattcataaaataccgtatgcattatgtcccagggtgtgaggaggcttgaaattctcaaaagaaaacaacttgattagaagcaaaaagaaaaaaaaaaataatggagcttatccttagtgggggcagcagaagaagtgggaagttaggaaggggtgagtaattttagaatagtctctttggtagtttccatgttcacaaatagggtttgtttgagggagcctgtggggaaacccagctgagtttgcagctggcactgattaccgatcactcaaacccgggcagatctgtacgttggtccagatagagtgggagcaaggaaacaggaggctggctttaaaaatcagcaaccttgaagctcatagaggttggatgtaggtggcataaataggctgtttaccacagggattacaagcaggtgtgctctgaacaggcctgtggtagagtggatccatagaatggttttcaatcaatgaatgaacatcaaacatctgtctatgtattgtaaagggacctccttctcaaaaagaataggtccatgtagaaaggggtatgatcatctggtcgacccacctggggggaaccaagccttagctatatacattttctttgggcccacctgtcctagatagctcttcattcacttgagacatcttaaaagcaacacaacacaaggagcagttgagaaaatcaactgaatcagcgctgtggaatgaacctaaccattgttttacaacaaatcccctcagcagcgatatatagagccaattgcaaagcatgcagagtggaaaagggactgtgaagaccagcacaatcttagtccaccctcttacaggaggcaaagggcaggggccaggcgaggtatgtcctggttctggtcccagggcccaccctcctcctcccccattagccaagtctgttttgcccagtttgatgttacagctcttgttctaagtcaaaggaccactctctcatggcagaacagaaattcttcatgaattttcagtctcttggccagcctcctgtccaccctctcccacgtattgaatacctaccatgtgctgggtggcgctatcatgggatgtaaaggtgaacaatacatatcccttgtcttctgagagcatccagtccaatggaagaggcagatctgaaaccagcaattaccagagtgctgagtgccacagaagagatgtggtcaaatgccttgggactagagagtggaacgaagactgtttggcacaggagagataaagaacaattcagaggcaatattaagacattgaggctgggtgtggtggctcacagctataatcccagcactttgggaggccaagctgggcggatcaccttaggtcaggagttcaagaccggcctagccaacatggtgaaaccctgtctctactaaaaatacaaaaaaattagccaggcatggttgtgtgtgcctgtaatcccagttactcaggaggctgaggcaagagaatcacttgaacctgggagccggaagctgtagtgagcagagatcgcaccactgcactccagcctgggcaacaagattgaaactccatctcaaaaaaaaaaaaaaaaaaagacattgagacaatattgtctaaatgagacaaggcaagtgctgagcacggtgcctggaaagcccttaagagatgatagctattgtcattttagcacttgagctacctctcaaagaacaagaggagtttgccaggtggagagaaagaagggtactgccactcataaaacagcatgtgtgggtcgggcgtagtggttcatgcttgtaatcccagcactttgggaggccgaggcgggcggatcacgaggtcaggagatcgagaccatcctggctaacacggtgaaaccccgtctccactaaaaatacaaaaaattagccgggcgtggtggcgggcacctgtagtcccagctgctcgggaggctgaggcaggagaaaggcgtgaacccgggaggcggagcctgcagtgagctgagattgtgccactgcactccagcctgggcgacagagcgagactccgtctcaaaaacaaaacaaaacaaaaacagcgtgtgtgaaagtgaggaggttagtgtggtgtagtgaaaattgcatgggctttgtagcagatacatcttggttcaaatcttagccctgccacttcctagttgtgactttgggcgtgtcaagaggagcctccttttactaatatatccagtgggggtaatgatgcctgtttctaagactcattgcggggattaaagtcaatttatgcatagtacctggcacacagtagagtctcagcaaatggtgagtaccactggggaggagtgaatcatcagtcctgttcggtgcagctggaaaattgggtatttagtgagttgggggaggggagggaagtcaggctggccagagagaaagctaaaatgtcaaggcccagatattggacggtttaggctgagagcttgaaactggacagcataggcagtgggagccatcagatgcttccctccaagggaaatacaggatcaaacttggtttaagagtgaaaactccaccagcgttgtggatggctggttggaaggtaagcggtggaggcaaggaaaccactttgggaactgctgcattcaatattcttgtcttgacaacagctcagattagcatagcaaaggctcagttaactcctgcagtcaagtgctgtctgggcaggcagttatgggcagtggtcgagtgtgtaggcttcactgattgtcctcttttttttttttttttttccccttgagacaagatctcactctgttgcccaggctagagtgcagtgatctgtgatcgtgcagtggtgcaatgacagttcactgcagcctcaacctcctgggcttaggcgatcctcccacctcagcctcctgagttgctgggactgcaggtgggagacaccacacccagctaattttttaatgttttgagatgaagtctcactgtgttgtccaggctactctcaaactcctgggctcaagccatccttccatcttggcctcccaaagtgctgggattcaggcatgaaccactgtacctgaccccttgtaattcttgcaagaaaaaggaaaaaaaataaaaaagagcatgggcttcagtgtcaaagccaatctggatttgaatcccacccctattgcttactggacattgggcaattacttaaccctatggagcttagtttgcccttctataaaatagggattaatagtacttttctcataggcttgctgtgaagattacatgaaatagtatgagtagctaaaacacatagcttagctctaggaatgcagtgagtgttcagtaaaagttgataattgtgataaaatatattactagctgggcatggtggtagctataatcctggctgcttagggaggctgaggcgggaggattgtttgaacccaggagtttgagaccagcctagggagcatactgagaccctatctcaaaaaagataaactaaaaaataaatatattatgtatatgactatagaagacttttttcatgtaactcctattaacatcctctggcgctactagtgttctaccaaaaacatcctgctttcagacttcctggagaagcagcagcactttctgctccaagaaatagtaaggagagttgccaggttctgacacagtggttcttgggtgcacatgagacccacctggggagcttttaaaaacgtcaatttctggctgcgttccagaccaattaaactagaatctgtcgaggtgggacccagagagcagtatttaaaaaaaaaaattgtgatgatttcttaaggaaaaacaaatacacaaaagtacacaaatcttaagtggatcaatttttcacaaactgaacctatctatttaacccatatcctgcttggagtgctaccagcactccagaagccccctctccaaccccgtatgtccctttccagtcactccctacaccctgaaaccacatagattagttttgcctgttgttgaattttacataaatgcaatcatatagtatgcatttttgtgtgtttgggttattttggttaacactgtttgcgagagtcatccatattgttgagtgtaattgtatattgttcattctcattgctgtacaatgtttcattgtgtgaacaaaccatattttttctccaaactacttctgggggcattttgggttgtttatactttgcgtctattagaaatagtgcaattaacattcttgtgaatgccttttagcgaatgtatacagaaattgctggccgggcgcagtggctcatgcctgtaatcccagcactttgggaggccgaggcgagcggatcacctcaggtcaggagttcgagaccagcctgaccaacatggagaaaccccttctctactaaaaatacaaaattagccgggtgtggtggcacatgcctgtaatcccagctactcaggaggctgaggcaggagaattgcttgaacccggcaggtggaggttgcagtgagccgagactgtgccattgcactccagcctgggcaacaagaacgaaacttcgtctcaaaaaaaaaaaacaaatttctgttgggtgtattcctaggaattcaattgcaggattataggacatgcccgtgtttaattttataagacattgctgaacagttttaaaaagtggttgtaccaatttatattcccactcagtgtgtaagaatttttgccaacagttggcattttctgtcttaaaaaaaaatttgagccaggtgcggtggctcacgcctgtaatcccagcattttgggaggccgaggtgggcggatcatgaggtcaggagatcgagaccatcctggctaacacagtgaaaccctgtctctactaaaaatatatatatatataaaaattagctaggcatggtggcaggcgcctgtagtcccagctactcaggaggctgaggcaggagaatggcatgaacccaggaggcggagcttgcagtgagctgagatcgcaccactgtactccagcctgggtgacagagcaagactccgtctcaaaaaaaaaaaaaaaaaaatttggccattctgatagatttgtagtggtctttctctgtgatcgtcctgtatattcccagcatctccaagtgattccaatgccaagtttgagaacgtctttcctaacagattttgcaaaagcagagtagaactggggaaagagatgttgtaatggtgagtgcctccccatggactccctgtgatgtcccagagtttttggtagaactgacctggctatcagccagtggagggagaatgttcacatgtgtcaaacctgacagcctgcctctcattcctatgtgctttatttggagcaaatggctccaccagaagtgatctggaagctaagggggaagcactatgaagctctggaaagatgccacagcaggactttcatctctttttataatttaagacctgaatgagaagggaagatatgagaagtgactagtgggctatatacacattgtcagagaagaagagctggtctttgtgacatatttttttgccccaaaggctgcctagaccctggcacttggaaggtgctaaaaaatggtcattgaaataaacatattagaactatccctagtgagagacaccacccaaagaggtgcagaggaaggtactggtgagaatttagtggaattgatgctttgggttcttttctttgtaatttctatgttgctgctgagatttcctatctgttcttttattacaagcataatttcctttacattcttgagcaaagttataactgctttaacaatctttattatttccaacacctgggtcaccttgagattggtctccattgattgccttttctcttgagtttgagtcacattttcctgtttgtttgtttttaatttgcctagtaattttggattacatcctaaatgttgtgaatgagacctgaagagactctgaattctattcctcagaaatatatatatattaatatatataatatatattatatttacattatatataatttataatataaatataatatatatatttttttaatcaggcaattaacttgaccaaactcaaactccaaactcagtctttcttgggtggacaacatctgaaatctttgctgaattcatttagctttagttgaactacttgaagtctgccttgtatgtacatcattcagtgagatttgggcactgtttatactcagaatttggggctactgttctgtgattcttttctgggatatttctccttattttccagctgtggttacctgaactctgtctttaaactcctcaaatagtaagagagtagttttctatccaagttttagctagtaagtacagcactgactgggcgcttcccgcaaataaaaagccattaaaaacacgaaagttatctagtgccatttctttccttcaggtgttgcctcctctccagtttctacttgcttgtagttgaacacatttagtgccttccaatcttttttttttttttttttttttctgtctagagttcgtaatagttttgtgtgggaagtttggtccagaaagagctactttgcccttactagaagcaggacctctctgatcaatagctttgttcatttagggatccttagacccaccctactttattgcctacctcatatagatggcaataaatatttgtttattggctaaataaataggatttaaattaaaaatggaagtgaattttcagagaaaattgccagaagaaaaccctgaaactagtagttacttattgttggcatcaagtatgaaacagagtgttcaggaatttgctgagtagaaggatgggtgtggtagtagagctccagacatttgagtgtagaccaaagcagttaacaaagtgaacctgagattttcacatgaggagataaattcaattgtgttagcaataccactttcgtggggtgaaactatggcttatagagaagttatcatgttcaaaggaaatacaaccggtgagagggaagcggaggtatgcttggagttctgtatacccaagaggagggaatcaaagtggaggaactttggctggagatcaaagaggggaggaacagaagtaatgctctaaaggcagaatactacagcctgcttctctgcatggtgacctggaaggtcatagatccagtactgagacttcaaaacctgcctatgggatggaaacttcacttaccaaaatgtagggcatctggaaactttctgatttattgtactaacagtttcatctctcagacaggagaggagagaggccagttgctgttgtgaatctggtttgggagttaccggatgaagtgaaagtgctcactgaggccaggcacggtggctcacacctgtaatcccagcactttgggaggccaaggctggcggatcacttgaggtcaggagttcgagaccagcctggccaacatggtgaaaccttgtctctgctaaaaatacaaaaattagctgggcagagtggcacttgcctgtagtcccagccactcaggtggctgaggcaggagaattgcttgaacctgggaggttgaggttgcagtgagccgagatagtgccactgcactccagcctgggcaacagagactttgtctcaaaaaaaaaaaagaacaaaacaaatccaaaaaacacacaaaaatgctcactgaaaaaaggagcacccatagggggttgagcctataggggtttggaaagcagattttatgaaatttaggatgagatatatttcctgcccaaggctccaaaagtgatgacagctccaacagtaagggaagttatgactttaatcagatatccttactctgcatagatttcatttattttccttcaaggactcctcttaccgtcatgcctccgtggctcatctttcctgtctgacatttttttttttatttttaaggagaggggatattaaaaatacttaactaatggcatagagactgaccaatcaaaacagatgccagactaatcagaagagatgctaaccacacacaactggaacatcagccctagttacgagttccctaacctctccgagtcccagttttctcctctctgaaatgggaacaatatctacattgcagagttggtgcagtgattcccagaaaggttacatgcaaagaacttggcaggtggaaggtatgctggacacagaagctgccatgattacctggcattctttgtttctaggttcatttcatgtatctagtttataggttctgcaatgttagcctttagtttcattaagcatgttttactctatactgacttcagcaagtatttgttctattaccagttggtctctctggttttttggccaaaatgtccccatctccctggtcacgaatactgtggattttctgaaatcttcttgaaattcatgagaaagatctgttaaagatggttatggttcctttagagattttcccagttccttcttctccttctgctttttatgggtgtagcctttggagttaggcagacctgggttcaaatgtcagttccatcccacactggctatgcacttaattggaatctgctctctgcgttgccctctgtcttcctcttctcattcttttgtcccccagggtaggactttttccttcaagttcaattctatgcttttaatcgtccttgtttccttggaattattctctgagcttcagtgaacaaactatatgaaaagtttttaaaaattcccatcccaggctgggcatggcggccacgcctgtaatcccagcactttgtgaggcaaagatggatggaatcactggaaatcaggagttcaagaccagcctggccaacatggtgaaaccctgtctctgctacaaatacaaaaattagctgggaggctgaagcaggagaatcacttgaacccaggaggcagaggttgcagtgagccaagatcatactaacacactccagcctgggcaacagagtgggactctgtatccaaaaaaaattctataccaactacttcctaactggctaagaatatccctggctaaaggggaggagatagcttgttagggatatttgaggtttctgaaatggagagagtggtcttataaggcagcaaattgtgttccccttcctcttatgctggtaatggtgtggagcccaagatgcttcaaatggacaagacagtgatccccagacctggatgaggaagggtgtcagtggcgacagtgccttggtccttttccattcctgaatggaccctatccaattaccaacagcatgctgtctccccacattccagggccagccttgggagggggaagtaggaactagaaaaaaactgtaaaagagccgcaagtgctttagaagatcttcctggtaaaatgcaagaagatatcagaaaatccattgtattagtgatcagggagataaggggacattttggttaacaaaccagatagaccaatttgtaatagaacaagtacttgctaacgtccatatggagtaaaatagggactgccctcctctgcttgagttcctagagtctggatctagtcaccttatcagggtggagtacagttcttcctttgctccctaggatgggttattggaaacattcctatgtgaacctgagatttccttgatgcttatctaccatggatgccacagtgagttgttgctgttgtttggatgatattctgggatttgaagggcctttccactcatacctgataacttcctagatccttggcctcccaaagtgctgggattacaggcataaagtaccatgcccagccaaggattttaatcagtggatacaaaggcaactactggatgatgtagaacagaattgcgtactcagtgtgcatgcagccacttcccacctcttcagccatggcaggctttgctaattgatcacaacacacgttctccctgttatcacacatggcttcgtaatccctctcctcacagtgcaccaagtagccaccaccaacctaagtggtggcacaagagaggaaagtttggtcatgagtgttgtgctgggagagaaaggcagggattagaggccacccccagcctacccgatgtgaagggccatccccaatttaataactgtgtaacccaggagtgtgttcggtagccacaggtggcctcctttggaaaatgatccctccagctgcaaagggagtttttatctccctgtgaagggagggggtggaccacactccctcaagcctggagaaactgtttgtaatttgactcccgtttccccaagcttagctattacataagcttctttagaagacaggctgtttggtttagcaccgtgactgtgactgactaatgcgtttgtagacatcatgttagctttgtgtgtgcccctgtccttggcacccttgttcctgtcccctacggccttctccacactgctgtacttacccaaaagtgtgtgggcttccctgggttcaagttcttgcaggggaagctcagcatggaagaccagtgtgttcatgggtattcctttacctgtttgagctgtggcctcctttgaagttttcttggagctgagcctgagagagcggcttcaccctgacaggcagaaccaatccaaatcatcaatcagcacctgcttaaaatgggccttgcaagttgtgtagcctggtggttaccaaatgctgggtgcagatatgcatgatagagtgcttagtcccaatacgatgccagcccctgcaggccaggattggggctcatgggccttcatggggccattcccgtctaccacccaccatagacctctaaaggccatggagttcctggtagtggggactccagcatcatgccatggctggactttgttgaattatcactgttagacagtttatcctcatgccaggctgatcctagttgttctttttaaaaaattattcatgtatttattttttaaatgatttatttttattttttagagacagggtcttgtcctgtcactcaggctggaatggagtggtgtcatcatagctcactgcagcctcaaacccctgggctcaagtgatcctcccacctcagcctcccaagtagctgggactagaggcacacgccaccacacctggctaattttaatttatttttgtagagacggggtcttgctatgttgcccaggctgtggatcccactcttcatattaccatgcctaagcctcactctgccctccagaggcctggaacaaagccgatccttttttgttgccttttgttaacacctggtctgctcccaatatggcccagccagttcagacagaggtcagtaggtctgttattgttccactgctggacatgatgacatgattcttctcctgggaaagctcaagatgcatgagttgtttcatcactctttgttcttgttaaatgtgtggtttttgaatcctgcctcctctaccttcagcctccccaacacacacaaagtcctgctaaatggggttatagtcaatgggcttcaggggacagtgacaagtcagagatctgaatgaaggagcacagctgggagaattggagttacggagttgacctgtggggatctgagtttcacgactgatttaaaaccaggagatctgtctatgatggcaatgcccaaagtctagaaggttcatcctagcaggagtaggacagtcagtccacaaaaatcccatgggaatgagattaggggagacaacattgatttctaattcaggtatttggagcaccaagggccccagaagtctctttgctcatgagttaaagcatctttatgctggaaaaaaaaaatgacgctattattcaaagaagtgtgttgtgggagggcgggggtgtacatcctttaggagagaaagtaggtcccgagtgagatcccaggagtaggaaagccagcactgtttgttttgttttcttctttccctcatgctcaatggtacaggaaacacaaggagaaaaggacccatcgccttcctccaggctgctgccaatattgtgtagagaagaatagctgaagaacatgaaaacaaatcttcacatttccttttaacagtgtgaactttgaaacactttctgactcatattttaaaatctcttaaatttgaattcaccttccttcatgttgtttttctcgaggcactaggcttgagtccaaaaatgtgtcaaccgactgctcccccagaattaagcagtcacaaagcctgggcccgcttctcccagctgagtgggcagggaaacctggctttgaccttcctacccttcctcaaagctgggcctcacctcaggcctgaagagccaagaaataaccattgtaaggggaagaggaggtatttggtaatatgcctcagcaagaggccattcattttgctacaagcagcagttgcctctggggtccctatttctgcacccctaaaaacatcattgctgtctcttaaggtgcttttggccacaggtggcaacatccaattcaactggctcaaataataaaggggcttttgttggcttggataactgaagtcctgagaccccttacttaaaggaccctgtttccctctggtgaccgccaagcattggtttcatccaaaagccagcttcctgcagggatggtggcaacaaggcttccaggagcaactgtgtgttgtgcttccagttcacagattgtgagaagagagagcttctgattgggccaactcaggacacgtgcctagcctcaaccactcactgtgctgggctcaggccgctgctgacaggctctggcccatcaggacccagcactgagtaataatgtgggaatacacagatcaccaccaaaccagtgcctctgtagttttcccagaggtatatttattcccccaaataacactcttgtaatagtcttctttcttttttgaaggtggagagtgtgaggagttctgtagtacatcctgcctactcccctgccatattttgggcgatgctattattcaaagaagtgtgttgtgggaaggcgggggtgtaccctgccatactttcttgcctttcccttaaagggtcagccctctggagctgagtctctgcttccccagatatgcactgactctgtctctccctttggggtcaacaagaggaatggagttcggactttgtcagacaagaggggctgagttaaggctctaggggaagaggtgaacacacctcagtggcctgttcctgcttccccaagggtcaagtgccttggcctcagacttcctgctggccacagtcaaactattttggttcatccacccagatgttagaaaaattaagtaccctaccctatttccccttgcttctgatttctcttctcatatcacagatacttcctggatgacctcacccgacctggcctccacagatccctgccacagatatcttgccagttctggacactctgttgacttgtgggcccatgtatcccattctctgcaggatgttccgtctggattttccgatgctgggcttgctatgtctccatggagctggttttcctccaaatgaggtcttccttggggatcccctttaagtcttgatgataaccattgctctcccaggtcctggcagtttgtgctgtgttcccatcaccctctggggctttctctggaagtgtggataggtgagcccaggtcttacaaggaggacagtctgcagcctattggagccatggctgccgtgggctgccccagcacccaggccagtgccctgtcttggggccaccccgctgctgtgtttgcagcaccatggcagttctttaattagaccaagcagggatttctcagacgggggtgggaggaggtgtgcgggtctattgggggaaactaggtcacctgaaaaccagtaatcaagagggagctgtcctcgagccccagctccaaggaacccagaggggcaaggtgggaggggctcgcggggagggccaagtcagagaaaatatgcctctggccccttttactggcccttgggagacattgttctcacctttctccagggagctgggcaactgcccttaattcctttgctgggagtagggaggacactgcagtggtgccttctgtctgcctggggcctgccaccctggggcccatggagggagcactgtgctgtgagtcaggccccaggtttagttactgctcagcctctgtatccttggagcaggtcacccactcccatgtgtctgtgccatccatccactgcacagggactgtgtctgcctttaccctgctgcctctctagccctgagcacaggcctggcatgtggtagatgccacctaaatatttgtcaaacaaaataatgagtttatatgagtgcttctcttgtaagattattgccacgaagatcaatggcaagatgggtttcccaaatatcagtcacttataagttttgccaacactaaacgccattgtcattaaatttttctttactatcaacttcctatttccaactgaaatagatttgtttaaaaaggaaattttatatcacaaccataaacaaacagtaactgtgaaaacaaatccacaggaaacaaaacaatgttattacattctatcctagatacagtggcttgcccaggccaggagctgaggcctgctttctctttgttttgaaggaggattggcatagttataaagatgttaagggtctgttagcattggactgacacttttctctggagaaagtctgaaagattaaaagagaagtgaaaagcctatataccctgctctctgtgtgggtccatgttacgtcaaggcttgttcctgtacttttgaaaatttccttggaatggattctccttccacacttagggaagcacttggctgagatgatggctggggaagttctttgaaagggataaagtgctgtaacagcgcaagtgattggtaccattactctttacttttagcatgtttttggtaccttccactcagaggtgatcagtcataataatgaagaaatgagtaactgtgttcaggatcttagggctgaaagacatctcacagaatacttaggccaatctgacacgggtggacattttatcctccagtgagtgacgaggaacttgccacctcctgagacagccattgaccacgagcacctttgtcgaattgcttgttggacagctctagaggccggtgtctgttcttggggtgcacacagctgcttccttgtacttccttgttcctccaaatgaggtcttccttgggggtcccctttaagggttgatgataaccattgctctcccagatcctggcattgggctgtgttcccatcaccctctgggtctcacgaggaggccagtctgcagcccattggaacctggctgccgtgggctgccccagcacccaggccagtgccctgtcttggggccgcctagctgctgtgttcaccctgctgtgtgttggggagactcacaggctctctttcctttcttgttcagagtggagctctggttatttggaaactgctgtctcattctgcctaagacagagcttgcaaactcaaatgacattggagctggcaaatgatgtcagttagtgagggcagtcaggcgggagtaatggggagcattggggactatggtaatggagagcgtatgtgccctatctaaaggggacagcccgactctacaccagttgatggtgatgccgtgtgagcccactgtggccccataccaagatgttctaagaaaagcagaccccccgatgttggatataaaatctccaagttgtaaatgtcagcaatgaattaaaatattttaaaacatggtgtggacttcgaccaaactaaccaacaaacacgatgtggatcacaggaggctttctggtcaggcctggcccacagccacaagtggctcatcactgccaacaagacttctctgctccttttgggctgggcagccacgtcctcttcgggccatgcttgtgcatgttggtttccagagttccctccattgtggtcagccactctgtacacctttgagcgctgcctaactccctctcagctcgtgtctgctcctttcaactggtgaaatcctacttctgcactgagattcaaatctgttgtcctgtattctggaaagccttccttgagaaccccgggcagactggctcttccactatctagcggtggtatgttgggtaaatgacttaatcactctgtgccttagtttcctcatctggaaaatgggcatgatagtacctagtactactattttattaggttactgggataattaaatggatttatgagataaattgacagacagaaggcagaggtggtccgcatccgtctctgaatcagggctcgtcacagagcaggacttcattaaatgtttactcactcgaggaagtggagtgaaataaacttgtgatctgctagctcccagagaggtctgactataataatgatattgtgtggttgtgaattgaactcttttgaactccttacttctaaaaaagcaaccaaaacatctatatctaagtggctaaaatagaaagcagtgacaatcccaaatgctgaaggggaactggatcactcacacattgctggagggtatgaaaccagcacagccattctggagaacagttgggcagttttcttttaaaagtaaacatgtgccaggcgcgggggctcacgcctgtaatctgagcactttgggaggccgaggtgggcagattacctgaggtcagcagtttgagaccagcctggccaacatggtgaaaccccgtctctacaaaaatacaaaaattagccgggcatgatggtgggtgcctgtaatctcagctacttgggaggctgaggtgggagaatcgcttgaacccaggaggcggaggttgcagtgagccgagatcacgccattgcactccagcctgggcgacagagcgagatctcaaaaaaaaaaaaaaaaaagtaaatgtgcaattaccatatgccttatcacttgtactcttgggtatttgctcctgagaaacaaaaacttatgtttacacaatctgtagatgaatggaacagccttaaactggaaacgatgcagatgttcctcaataggtaaatggttaaacaaattggggccatccataaaatggaatactacccagcaacaagaagaaacgcactattgatgcatgcagcaatgtggatgaatctcaaaggaatgatgctgggtgaaaaaagccaatcctcaaaggttacctgctatctgattctatttatataacatcttttgaaatgacaaaattctagagatggggaacagattagtaattgccaaggcagggacaggagtgggttggagggggagcctagagaaggagataggtgtggttatgaactgaggtggtagatacattgatacaattgcataaaacaaaacacatccaaataagtacatgtgaaactagggaaatcggcataagattggtgggttgtatcacgtcaggtttctggctgtgatactgtatagtagttttcaagatgctaccactgggataaactgggtgaagtgtacacagaatctctctgtactatttgttacgctccctgtgaatctacaatgatctaaaataaaaagtttaattagttgaaagtgcattgcaagtgtattcaaaacagaaatcaaaacaaaacaaacaaaaggcaaccaaaaccagctagcttgtctcccattgagccttgccattggcttatttatgctggaggtcacacccactcagaccctggaacttttgccctttgggcattgccaagccaaccccttccccattctgcctgcttactctccagtctccgagctgggagagacatgaagaacgatctggatctgacccaatctgagcacctgaggatttagcctgagccctgctcttcagcttctgtagaaagggcttttggaggggcgggtgacgcaggcgacccaggagattaacaacgcttcctgaaaccaaccaggggctaacccaatactctttgagacagtggaccacatcacacagatgtagactcctgccattctttcctgttacccaacaaccataaaccagccttgcctgctggttcacaaacatgctgcatttacatctccctaccattcctcctccaagcttgtgtctcattgtttagtgtcttaatgtttagggccagctcttttttaaaaaattattttatttttttgtagagataagggtctcgctatgttccccaggctggtctggaactcctggcctcaagctgtcgtcccaccctggactcccaaaatgttgagattgcaggcattgagccagtgcatccagccccagctctttttattccttgcacctgtaacttctgggaggtggataggacactttgcaggtggaggaacaggcttagagaggatcaagtgattgtcctaagaccctttccctctgtgtctgaaagttcatagagtccgtgctgaagaccagctggctttagactttgaaattttgttgacctcatgttatttgaaactcatgagagcaaggatgtaatttttttttaaaggtcatccaaagagagaaactttaactaagattttctatgtcccagtagttcagcagtttttaaacttttttgtcttaggatttctttagttccttaaattgagcatcccaaagagcttttgtttatgtggattatatctgtcaatatttatcataatataaatgaatattgaggaatttttaagaatagcattaattcctttaagataaaaccataaacccatgatatattataacaatataataatctataacatatttttattagactgttataaaagcataacatataatatataacattttgatgaaaaatagctatttttcaaaacaaaaaaaatttagtgagaaaagtgatgtttaaaaattttgcaaaattctttatgttgagcttagcagctggattcttgtatctacttctgcatttagtttgttgcaatgtcacttttcatatagctttgggaaccactgtatactcataagataatgagtagaaaaggttagtaatatcttagtatagttatgaaaatagttttgacctatggacttcttgaaatggtttcaggaattccctatggggttcccagaccacactttgagaagcactgcaatagtgtattgtttcttctggtctctttcttgtcctgtctgtcccatctccagtacaacttgcatcccatagtgatcagaacaaaagaggcttgagcagaagtgtcagatgttcataattctgaggccttggatgtttgtatagtctccagatttttgggggcctgcagcccccatcatgtcctgaccctccctgcaccccttctgattccagcactcagatacccaaatccttaaagtagggtgactctatacaagaaaactaaaatggcatggttcttgttaaatagctgtggctagagaggcagacaaccaagctatccaatagagctttctgcagtgatggatatattctttatctgcattgtccagtatgaagcatgtggcgattgtgcacttgaaatgtggatagtgcaaccaaggaattaaattattttactttattctaattgatttaaatttaaatagccacaggtggctactggctgctgcattaggcagcatagccagaccttgctgatacttacagggccactgtaaggatttgcacttctcttgaggagcaatggaaggaaaacctcaaaagcgtttcgaacacggggcgttgggggacgatcagatctgagttgtggagtctgacacatgtgttcatctgtgtctccctccctgccacaggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaaggtaggcccctctgtgccttggcggccacgcagctgccttggcctctgatcagggtttggaatccaggttctgtgcagtagacgtgtgggcaaggcaggtctgcagacccacttccaagttccagcagccccattcctcttaggaagtggacgttcctaggaacttcgaatttatcttagacttcttttttttctaagacagggtctcgctctgtctcccaggctggagtatagtggcgcgatctcagctcgctgcaacctctgccacccaggctcaagtgatccttccacctcagcttccctagtagctgggatcacaggtgtactgccaccatacccagctaattaaaacaaaaaaaatttgtagagatgggggtctcattctgttgccctggctggtctcgaattcctgagctcaagtgatctgcccgccattggtctcccaaaatgctgggattacaggcaagagccgcagcgccaggcctagactttttgtttaaacatcttcgttcatttgtttttatttatttatttatttagacatagggtcttactgtgttgcccaggctggtctcaaactcccagcttaaagggatcctcgtgcctcagcctcccaagtagctagtattataggcaggccaccttgcccagctgtatttttttgggaacaaggattccagcctttggctgaggaataccataataactttctttccctcccacaaatatttacagacaaccacaaatacttacagacaccttcttttgcattactttcctagatatagtggtgaacaagttggatctggtttctccccaccaaaagctcaatactcacaggatcttgcaattcataaagctctcctctgtgccagaccccatgcctggcaccctctgaatgctgttccgtgtattccgtgtatgtagcctttgctgcagtcataaatggtgtagagggatggactctgaagtgagactacctgaatctaaaactggctttctcagttccctacgtgagcttgacaagtagacaagtctcttccactctctatacttcgtttacacctctgtaaaatggggctaataagaaaatccactttaagggcttgctgtgaacattaagttagaaaatccctgtgaagttcctaaatatggtcccttatgctgaggaagtgattattactgttttattttattatattagtatattttatttacattatcaaaggatgtccataaagtctgaaaacagatatagacaatgctatctaggatattttcactctgtaaagtgaatgagtaaataaatataaacaaacatgtatacacattcatacaatctatgtttccagatttttttcttttttttttttctttttttttttgagacagagtctcactctgttgcccaggctgggcagagtgcagcggtgtaatctcggctcactgcaacctctgcctcccaggttccagcaattcttctgccttagcctcccgagtagctgggattacaggcgttcacctccatgccctggctatttttttaaatttttagtagggatgggatttcgccatgttggccaacctggtcttgaactcttgacctcaggtgatccacctgccttggcctcccaaaatgctgggattacaggcatgagtcactgtgcctggcctatgtttccagattttatggataccttgtacttgccatgtttaatttaattatattatttttgtgtctcatgagctagatatcatgatctgtactatgtatagtgctttaagagccatgtatgataacacccattttacagatgggggaattgaaactcagagaggttcagaaccttgaccaaggtggcagagcgggatcagaaccactggcatccgactcttgtcactgccctcatggccttataggtttgcttcctgttgtaggaatgaatggagaatccatgatgtaaccacagcccccttccctgggcttgttcagaggcggtctcgcctgctcattgtgagccaaggtctgtgcacctccctgttccccttggcgcccatggcccatccctgtataataagccttcctggctgtccctggagaggcctagccatgcttcctgggtccctgcacacaccttccagtcaatgaaagagcagagaggtgtggcacttctggcccaagagggtgctgggttttagtcaccttgctcttcaggttctagaaccctctgagaagtgtaattccacttccacctggctgcacagggctctaggaaacgagccaagaggcatccctggaaccactctgctgggagctgctccgctgaaagcctggggtgagcagcctgggtgaaaagagaggtggaatcttgggcttggggacatggccccgaggctccttcccacgtgcagtttgccaagtgatgcggcagccccatccccacgcagtgggtggcttgtcatgatgtctaatttttgttgggggcggaagttcatcagctcttctctcacccctcgttattgactgccttcttccctgacaaagccccattgcccctccctgaggggctctgtgcatgggctgcgggcttcagaccatcctcccagccccctgcccagcccctaccccttgctgatgtcttgtttcctggttagaaggagcactgggctgggagtggagggatcagtgccccgcagccctgcctgtgactttgagcagcttgtttcacctctatgggtccagtttttttgttttgctttgttttgtttttgagacgaagtctcgctctgtcgcccaggctggagtgcagtggcacaatcttggctcacggcaaactctgcctcccgggttcaagcgattctcctgcctcagcctctcaagtagctgagactacaggcatgcaccaccatacccagctaatttttgtatttttagtagagttggggtttcaccatgttggccaggctggtctcaaactcctgacctcaaagtgatccgcccaccttggcctccaaaagtgctgggattacaggtgtgagccaccgcgttcagttttttaatctgtaaaatcaggttttgaaagcttgccctcaagagggtatggcaagacttagacaaggtcctggatgtgacagttctttgaaaggttaccctgagacctgtaccagcacggtgataacgcactttattttgttttgttttttacagactttaatgtttttcagaacctaaatatgcacagatacattcttcttgtaaaaatcaatcaacgtagaagtgtacaaagtaaaaagtcctttctgtccctcccttcctccctctctccttcctcccctcctttgcttctttttgtccatccatcactactgttgttagtttgatgtttcttttccaggtatttttttcatttgcatatgcacttgtggacttaagagaaatatagagccaggtttcttttttaaaaagtttttacataagtgatggtatcctggatacattattctgcaattttctttttttttttcccatccaacggtatatcttggagacgttttcatgccagaacatgtacagtacagatctgtgccattatttttatctgctgtgtagtattccatagtatggattaccagaattttctaactagctccttattgatgcagatttttccagtagcttcgcttttgccacagtgaatgttttatttccatgtgcaaatgtttatcgaggacagatgtgatgaaatgaaagagatggatctgaaggtattaaatttgaatgagaaaagtgctagaccccatgggctggtccccctgtctctatggggcagccaagtgaggggaaggggccagaatactgtgctctgtggcaggctcgtgggttggttttagggtccacagttgcctgggtttggatgaggggtgtgaggctgccatcagtcagcccttgacctcactgggctatgctcagcttcctggcagcactacagagcctgctgctttcagcaggctgggaacggctgcttcttgctggtggagctggtgtttgggaggctgccggggtgttagctcacagtggcgtgggagcgtggggtggcagctcccccactcccctgagctcacagcagcctctgagtcaacctcccccacctgcctggggaatgtgagttgtttccagagaaaggcaggctaggaactcactgagtttcatcctctggtcccatattgcctttagactagtgtccttgcccttggacctgcctgagccccatgctcactgctctcactgccatcaccctctgccccaggcgacgccagctccaccaagatcctcccatattccctgcgttatcttacctccacacctttgtatatgcaattccctctgtctgggacactcttcctgtgactaactcctgtaaccctcagctttgagtccagcgtgatctctggggagccatctgtgagccttttcccggccctggttaaagtagcaactcaatacgtagctgatgtttactgagagacagtgtagtgtcatggctaggagcacagaccctgcagtttgtcctccaggattcaaatcctagctctaccgtttactagctgtgcatccttgggaaagttactttacttctcagtgcctccatctccccatcggtaaaaatgaggatgatgatgtacccgcttcataacgttgttggggggttaaattaagttgataaatgttgaagtggtatggtcagagctacgtaagtggtataaattgttgttattctacactattctacatttacgtaatctattattacagcatattctgattgtcatcattgttattatttatcaggtgctttgtaccaggcagcttgccttacatatgttatctcggttaatcttcacagcaactctctgaggttagagagtcaaaccccatttttaaaaaatagcttggggttcagtttacatattataaaatttgcccactttaagtgtactattcaatgattttcagtaaatttacagaattgtgcatccatcagccacaatccagttgtaaaacattgccatcgctgagtggtgtggctaacacttgttatcccagcactttgggaggccaaggtagaggatcgcttaagcccaggagttctagaccagcctggagagcctgtctgtactgaaaaaaaaaaaaaaaaaaaaaaaaaaaagccagccgtggtggcacttgcctgtggtcccagctacttggaaggcttaggcaggaggatcgcttgaatccgggaggttaaatctgcagtgagccatgattgaaccactgcactctagcctgggtgacagagcaagaccccatctcaaaaacaaacagaaagccttttcatcatcccaaaaagaagcctcatgcccatttgcagtgactcctggttcccagacccaggcaactataatctactttctgtctgtatagatttgccttttctggacatattatttacatggaatcatacagtatatgatctttgtgattggcttctttcattcagaatactgctttcaaggttcatccttggtgtgacatcatatatcagggcttcattccttttcattgccctgtagtattccattgtatagatattccgcattttgtttatccattcaccagtaggtgaacgtttggattatttctattttggggtaggatgaagaatgctggaaggcaaatttgggtacaagtctttgtgtggatatatgttttcatttctcttgggtcattacctaggaatagaattgttgggtcatatggtaaattatgtttaactttttaagaaactgctgtactgtcttggaaaatggcttcactgtgtgaattctcatcccccattttacagatgagaaatttgaagctcagagagactaagtcacctgccaaggtctcacaggttttaagtgtcagactcaatcccaggattcaaacccagatcagtttctccgaagcccatgtatttaaccaccaggcagtcctgtacttcctgcttttgttttcactagaaaactagagaaccctcagttgctgtactgatctgtgtttgttttggccttaggcatcctggtgtttctgctggcatcttgggccctttgatttggggcccccaagataaactctttagccccagatataacttctttctagggccacaatagcccagcctcccttgaaaccattgaatgtatgttaagttgttagagacttctgtttttctctcagaatgtgtagggttttctttatggaaattctcattcaaaaaatgtttgagtgattcttctgtactctaaatttaactcttattaaatttaatgatttttctcactgtaaaagttttcaaactcttttttaagcagtggaaacttttctttaaatgagatattatgcagaaacccaatatgtaaaacaaaggaaggagctgttctgactggggtcaggtgggtggggtgctcagtcatccctgccacctgcaaccccctcccccacccccaggcacagtgctggacacctgggccttgccaccaccatcttaaaccagcagctcatctacaggaactagctcagactttcacttttggtccttttaaaaagggaagtttcttttcttctaattattaaaaaaaaaaaaaccctgttattgttacagaaacttttagaagtacagaaaaaaagaagcattaagaagaagataaaatcacccatattccccctgaacagcaacaaccattgataatattttggtattgttgtgtcaggcagcgtcctgggaggaaacaaatggtgattttatatggggtgatttgtggaaagtttgataaaggggcagtttgtaaagggtttagggaagtggtcctcaaactttttggtctcagaggccctttatattcttaaaacctgagaactcctaaaagctttggtttagctgggttctatctacccatatttactgtattcgaaatttaaacggaggcattaaatatttattcattcattaagtcagaatgataaacacattatctgttggctatctgcttctgcgtagcagatgaactcaaaatttagcagcttaaaacaataaacatatactgcctcacacaatttctgtggctcagggatccagagcagctcagctgggtggttctcgttcaggatatctcataaggttgcagtcacttcaggatttacctggggctggagaatccacttccaagatggctcactggcatggctcttggcaggaggcctcagttccctgccatgtggccctctctataggacagctcgagtgttctctcagcatggcaggtggcttttttcagagtgagtgatccaagagatagaggaatccgcaatgcctttatgaccttgtgttggaaatcatgtaccatcacttctaccatcttctattcatgagaaatgactcactaggtccagcccacactcaaggggtggggaattaagcttcatcttttgaagagagaatttgtggacatgttttaaaaccaccacatgttaacataaatatttttatgaaaaattatatttttcaaaacaaaaaaaaaagcaatgaggagagtagccttgttttatatttttgcaaatctttttaagatctggcttaatggaagacagttggagtatcttatctgcttctgccttcaatctgttgtgatatgttattttggttgaagtaaataaagaaaatcttatgtagttggaaaagggaggaaatattttaattgctttttcagatattgtggatattctttgatactacatctaaactcaacaagtagtagtttcttaaaggttagttgcagtgctgaatctgaagccatatcaatttacatcaaaatccattggtctgtctggcattttgaatggttcttttacccatgtgtacttttttttaatgtaatatattggatctgttagaaaatattggttcactgagttacacagatcttccaaatgttgacacattgctttatacaatataagaaaatgtatagtttcaataacaatcttgccatacaattattcaggtactgggaaactgtaagttcgtggtagctataaaagttttctaaaatttggatttttgcttaaaagttcaaattctatcattggtaacaaatgctgtcagttgtgagaagatccatttgccctttttaggaaaaaaaacactgcctgttaaatactcaagtctgaataaccattgtttgctagacatcctttaagtaaaactagtgctccatgagagaagagactagcttagcacacagcttaaaaaatggctcaagtaatgcagttggagacaatgattattctttttttgaacttcccattttgtcacatggaatattaaaaggacatgtactcaaggattaaggtttcataaaattaatacattttattgctttatcaaggacatttttaagggaaactggtattgatttttttcttttgattgcacatacaaaacaatgaagatggtgattgctagtacagcttggtgccactaagttaattctgttaaaacaacagtagttttacccaccattgcttttacaccatcagtgcaaatgtcaacacagtggaaaatgcaagtaatttcttagtgttactgtgaaaattattttgatgttttaataccctgaaagagtctagagaccactttgagaaccactggtttatgggggtcaacaaggaatgggacaataccctgggatagcaaaagttgggagatcttacccaccccaccccaccccctgggcctgaaggagacaaggaaatgaacctactggaacctaaggaaggcaccgtatggagagggctacctaaaggagcagtggctgccactccatgcccctgccattctggtgctttcggtgacaaacctaaccagaaagcagaatgcaaggaagcctttgatgtagtgcaagtcaactggcttcctcaggcacggagaggggaagatctagagggacagatggggcagagagtgagcccagctgtcttcagcccttcggatctacacacaaacaaggagtgagtttgtgtacatttaaaaaacaacttttagggccaaatgtggtggctcatgcctgtaatcctagagcattgggaggctgaggtgggaggatggcttgagctcaggagttcaagactgcaatgagctgtgatggtgccactatactccagcctaagtgacagaggaagactctgtccctaaaaaataaataaacaaataaataaaaatgtaaaagtaaaaacaactttaaccctaacattcacttgtgaattcagcaaaattagtcatctgctagagctgtggtatcagggagagcctgtctgaggaggtgatttgggctcagacctgaatgtggaggagtctggaggaaatgtacaaaggatgtgtgatgggaacagggttggcgtgtttgaagacaggagaaagatgggaggtggaagagtagggggaggaggtggttgagggagagcatactgaccgtagaagactagagtaggaactgtacatttgatttcgatgaaaagccactggtggttttgaaaggggaatcatgtgatgagatacagattttgaattcgggatggattttcctggttgctgagtgcagaattgactgtagcaatctattttcgcagggctgtgaggggagcagggaggctcatgagaagccctcacagtagcgtaggtgagagcctatggtggtcactgggcgatgcagaaatcaggaggtggagcccacagggcttctgtgtcaagtgacagaggagggactcagtgatggcttttgggtttttggcttgaacatctaggtggatgacagtgccacattttgagactgggaagatcggagtaggagggaggaggggatttggagagaattgagttctataggactgtccaagttgacatgtccttttaacatccacatggagatcttgaagaggcagatgaatatgtgagtctggagctcaggggagatatcagggatggttataatacttgggaagtcatcagcatgatacaagtgcagtattttcaaaaatgcaggactgtaggaggtcatctaggaagcaagggtagttggagcagagaagggatcgcagagaagggatcactagagaaagctctgggacacctcaatagctgcatgttgacccaagaagaagagaacaaaggagaccagaatcatctactcagaaggtagaaagaaaaccaggaatagtgtggcatctcagaagcctggaagaaaggactgtcagctcagtcaaatgctgttgaggggttgaatattttgtcttatctttatatactctttggaaaaagagatttctaatgatgacctcatatatcctatcatggatgttccataatttatgcagctactcccttattattgcattttgaggccattcccaatttttgctactataaattatgccgtggtgaatatcaatgtataaaagtatttggttggccgggcgctgtggctcatgcctgtaaatcctagcactttgagaggccaaggcgggaagatcacttgagcccaggagtccaagaccagcctaggcaacatagtgagaccccatatctacacgaaatttaaaaaattatccaggtgtggtgacgtgtacctgtggtcttagcaacttgcggggtggaggtgggaggaacttttgagcccaggaggtcaaggttgtaagctgtgattgtgccactgcactccagcccaggtaacagagtgagaccctgtctccaaaaaactaaataaataaaataaaaataaaaagtatttggccatagctttgattatttactaggtagattcctagatgttcattggctttgaggtctcgatataaaccactcatttgactaccagagaggttgtatcagctgtgtgtatccatccctgctatctccccacctcatcactacctgccacatcaatgctggatgatgacattgaaaacacacctttgctgatatatttgatatatggaaaatagtcctgttgtcttaatttgcataaaatcgagacagttaaggttgaatacctattcataagcttactggtcatctctctccttctttgagttgtctagtttgtttttttgttgttgttgttttgagacggagtctcactctgtccccaggctggagtgcagtggcacaatcttggctcactgcaacctccgcctcctggattcaagcaattctcctgtctcagcctcccgagtagctaagattacaggtacccaccaccacacccgggtaatttttgtatttttagtagagatggggtttcaccatgttggccaggctggtctcaaactcctgacctcaggtgatctgcctgcctcagcctcccaaagtgctgggattacatgcatgagccactgcacccggactatttgttcattttttttactagtgtgcttcttattggtttcaatgattgtgtacgtttatgtttgtgtgtgtgagaggagacagggagaaggtgagaaagggggagaatgacattggagggagagatgccaactctttgttgtcatgtatggttcatatattttctgcagtgcgtgtatgtgtttgctttaatgttttgtttatagtaattttttatgctttggagttcttattttttatattgtcaaacctaatgatacttgatttctttttttaaaatcattttattttttttatccctttaaagcagggaccagaaaactgtggcctgaagtccaaatcttcccactgtctgtttttgtaaataaagttttattggaacacagccatgcccattcatttacatattatctatggctgctttcacattacaatggcagagttgagttgtaacagcgaccatgtagcctgcaaaggttaaaatatttactttctggccctttatagaaatactttatgggctcttgcactaaaatgtttcctcatctagtgatgtatattaaacctatgttttcttctagggttttttggccttatttaaataaataggtagtatttctggacttcattttagtatagagtactaaatgaaaatctgtctatattttgtttccaaagcatcagcaattgtcccaacatcccttccttccctacaagtttgtgaggccacccttgtactctagagcctcatctgtaatgaagggtaactctccaacctgtctattctgttccagcaacctattttggtgccagttacatactgctttcatccttgtaggtttatattgtggcttaatatgtgataaaacaagtttttcctcagattactcttttttttcaaaatgttcctggttattttcagctgttcacataatatttaggactgtttggtcaagttttccctccaaacctcaaaaatagatttctccaaagctttgcagggacatggatggagctggaggccattgtccttagcaaactaacacaaggacagaaaaccaaatacagcatgttctcacttacaagtgggagctaaatgctgaaaacacatggacacatagaggggaacaacacacactgggtccctattggagggtggattgtgggaggagggaggagatcaggaaaaataactaatgggtactaggcttaatacctgggggatgaaataatctgtacagcaaactcccatgacacaagttgacctatgtaacacacctgcacttgtacccctgaacttaaaagtttttaaaaaattaaaataattaattaatttggaccaaagtgatatgtttatcatactgagtttttctaagcgggcaaatagcacatgtctctgttaagcatgtattctttcttgtcttttaggaaagctgtagggttttttgtttgtttgtttgtttttgttgttgttactgttttcgtataagtcctgtttaatgtcttaaaaggagggctttgggttttgtacattaatgttataccaagcgaatttactgaattcaccttagtcttggtttttcagtgagttatcttgggggtttctatttagaaaagaacattatttgcagatgataaggttgtctgatcattccagtgtttcagtaagcctggagatctgagtcctatccagattctatcctctctccccttctctccaggctaactacttccgttccttttcatattcttttatgacatgtggctttgagatttgtgaccatgctctactctgtctacgttcttcccaaagtctgatctggctcactctggagtgaatggaactgtcactttcctcgttctggttgcttttgcctgttagtatgacttaagtttccattagctttttgggtagctgctgttgactcatattgaatttataagaaaacaaaacccccaagtcagcttcccattaatgaagctacattttccccatcctgatttaaaaacaacaacaacaacaacaacaaaaaaaaaacaaaaaactgtttgttgaagcataatcatcagacagaaaagggtaaaactagttgtattttcatgtgctgagcatacccatgtaactaatcagcactcagatcatgaaacagaacattaccagcaccccaaaagtcttcctggacacacggttgatttttaacattgaggtcaagcgctgcatttatcttgttgagttttgagcccaattatctacctgttcagctagttttggattcttgaatgatacgttaggacttttgtgtcaccagtgacaaaaactcaagctaacaaggttaacaaaacagtgttcacgtagtggagagttcaaagatagcacagcttcaggcacttgtggatgcatgagactaccaagaaatgtctctgagaagacgactatcagcagcttgaaatatatatcctaaatccttttggcaacctcagtaagaataatttattttcccagaagtgtcccaggctcaacaagtcccagaatggaacctcattggctatgaggtcgattcctgagtcaattgtaatggctagataagggaagcaatgctatgattggtctggttggagccatatgcccactcctggagtctgcttctcccaaacacatggactgacacttggtattatgttgtacctacccactcccccaaaaatattgggatgatatttccagaaggagggagaatggatgcttgtcaggccataattaaatatattcacctcaaatgaaatattcaccggcagtttctactccatatcattcataattgcaataaggatttgccttctagaccagaattgtgcaatagaatttttttctgatgatggaaatgtgctgtccaatacaatagctgctaaattttttattgtatttagttagaaataatgtagtcaactgtggctaagctagaggctgctgacttagaaacacagtcataggccattatccaaatccctgataaaaatgttgaatagggcccagcgtggtgctcacgcctgttaatcgcagcactttgggaggccgaggtgggcagatcacctgaggtcaggagttcgagaccagcctggccaacatggtgaaaccctgtctctactaaaaaatacaaaaaataaccaggtgtggtggtgggcacctgtagtcccaggtactcgggaggctgaggcaaaagaattgcttgaacacgggaggtggaggttgcagtgagccgagatcatgccactgcactccagcctgggcaatagaacaagactccatctcaaaaaaaaaaaaaaaattgttgaataggtcatgggcagagatgctgcctggggccacacccccggagaccttttccagattaatgtatcaaagtcaactactgggaatagttgtgcaactgaaatgaacttaactacattgttatttgcagttggtatgtgggaacagtagcaggagtctcgacaattaaaaaacaattaaaaaaaaaaaaagctggctgggcatagtggctcacgcctgtaatcccagcactttgggaggccaaggtgggtggatcaccagaggtcaggagttcgagaccagcctggccaacatggtgaaacctagtctctactaaaaatacaaaaattagctgggcatggtggtgcatgcctgtaatcccagctactcaggaggctgaggcaggagaattgcttgaatacaggaggtggaggttgcagtgagttgagattgcaccattgcactccagcctgggtgacagagtgagactccatcttaaaaaaaaaaaaaccatctttcctacaaaacttagaagacgatttctctctgagggttaaattacaacaaaatgtgatggatcagagtagcaattcatgcacagacatttatggaacatagtctggacatcatcaggctggcattggttgttcagtggtgaacaaaacaaaatgggccagaccaccttggagctcagagtctagcaaagtcattgtgaagagagcatagtattaacatgcttaacaatggatggtgttattataaagaaggccttgctgggcatggtggctcatacctgtaatcccagcactttgggaggccaagacaggaggatcacttgagaccaagagtttgaaaccagtctgggcaacatattgagactgtatctctaccaaaaacaaaaacaaaaacaaaaacaaaagccaggcatggtggtgtgggcctgtagtcctagctgcttgggaggctgaggccggagaattgcttaagcccatgtgggcaaggctgcagtaagtcacaattgtgccactgcactccagcctgggtgacagagcaaggccctgtatctcgcggggacggcggggggggaaggccttgtcaagaacagatgccagaaaaagggggctaggagatcatttatgaacaattctatttaaatatcgttcaagggagaggacactgtgagcaacaactttggtgattaccatcccattgctaaggacaatctgattatggaaaaaggggacttcaacccatcttggtgatcttggcgtaatcattaaacatgatgattatgtacaaccttctgattataatttggcgtcccagccaggtctgcctacaagcacagaatgagttgaccgtgcttaactgaatttcagacatgcaaggcaattattctcctgtgatcctggcattgtgtttttatgcagcagcctcataaacttggatagtatgagactgctcttgggagaagaaactgctgttggtaggctggtcaaccatggtcgatcaccaaggtgataccatcctagggatcttggggatatttaaccaattggaactcccttggaacctcccccaaatcaaaccacaatgacactcaaccagcatttccccagggtgctaataaggaggtgtatgagaggcttgtcaggtgctcaatggagtctagacattttctatctttgacatttctcagtgtagtgaacccattgagaagatagatgaggcattgctagcatgattgattcttgcttggcttctagggaccactgtttcctttttttttttttttttttttgcggggggtgggggtagcatggggggataaagtcttgctctgttgcccaggctggagtgcagtggcatgatctcggctcactgcaacctccgcctcccaggttcaagtgattttcctgtctccgtctcctgagtagctgggattacaggtgccaaccaccacgcccagctaatttttgtagttttagtagagacggtttcaccatgttggccaggctggtctcaaactcctgacctcaggtgatccattcccctcggtctcccaaagtgctggaattacaggcatgacccattgcgcccggccccactgtttcctttctaatcgagtgagaaaatggtcagtatttctgtcaacaaaattcatgaggctctttgtacgcacagacttcaggcctttctctcaacaatcgccaaagctggagcatcacatggaggaacactggggtttgaaaaacaggaatgttccagaatcttctcagagtattacattttccaacatgtccatcccatatttgtaccaacaaacagagctggtcccactgccctcatcctttgtctaccatgttaggctgaggaagttgcatgcagagcagaggtgaagactaagagaagaagatacaagaaacctgctgagtaggggagagggaaatggtacctctgccagttatgctggaaaagctaaatgaaacccaaatcttgatggaggtgttagggttttcagtctttcaagagaagctcaggacacaggctttttggcttaaggaccccaaatttcctgggcaccacaaaagtagtaacggcagtcctccaggtgaatcagtgtcaagagctagactgtaatcacttgccttttgttgcattacaagccactcttgaaacacttagtggattgaaacaacaacttcttatttctcaatgattctttggcttgactgggcactctttctgctggtcttccctgggcagttcttctgctggttctgcctgggctcactcatgaggctacaggtagctgctgggtcagccagtgtctggggctcagctgggatgacctggcctctctctgcctgtggtcctttatccagcatgatggtctcagggttccaagcaagtaagccccaatgcacaagtatttatccagcctttgcctgcatcgcgcttgctcatgtctcattggctaaaacggatcacgtggccaagctcagagtcagtgtgggaagagtctatacaagcgcttgggtactgaaaggcatgattcattgggggccattgttataatctaccacacattctagactttgctttgctttagatccgaattctagcaactcgatgtgataaccctgggcacatcatgttgctcgaacactgtaattggctattgatgtccctggaatgtctgagatgtatggggtggaccaaacactgcctctctctgggaaccccggactttgggttgagaatgcctagtgtttaggtggcattgactctaaaaccatgtggcattcagaattcagcactgggcaatggcgcatatgctgatttaattttattagcctattagctgcatagacacaacagtgatttatgtgattttataatattatgttgaaccttcaataattgggattaaagtctggattgatgttgtaacagaaacaggagtagaaaaataatcatcagccagatggaagaaattattagttcacaaatgcagtgtgctcagtaataaaatctttcaaaatgtggatgacataggtgcaatagaatataaagaggccttcagtggaaagcttgggaagctctgcagagatgcagtggaccttgaaggttaagaatatggagtcagacaaaactaaattttaatctctattttgtgaccttgggcaagtaacttaacctcttttggactcagattcctcatctgtaaagtggagagaatgatgcagggaagggaggggagtgggtcaccgtgcagattcatggaaataaaggatagacagtggacacggtcagtttggctgttactatcatctgccagtagcctcagttacaataagccagaggcaagattaacatctcttcctttttctttctaattcttctgctccccacattgccataactactcccattttctctatctctgtttactcaatggcggccttctatcagtcagtcacataaaagtattcttattgcagtcatttacactttagtatgaatgagtcagcacttttttgcagcaattttcattggaagccagtgggaagtgaaaggctttggccacccctcataatatatgacttaaagcctgcttgcaatagagagcccttgcagagtctctaaaagaaaaggacctgccccctgaagaacttctgagaccatagacctcatggtgcccagcttttcctggttgccatgtgtcatctctaaagacagccatgaatatctgttttggttgacttgagccatttgaatgtctaaaacccatcttaataacaaaagctctttggagggaccctaattaacttctttaaattgctttctctaaacttttggaattaatacaatctgttcccttgttattaaaaaaaaaaaacaaaaccctaggatacttcgcaaaacttcccccaagttacttggcagctaacattttgtcaaggaggcatggtggccaaccttcccctgaatgggattggtttctatatagtcattccttccggctcatgactttcttctccatttgctgcccacggacgccgaaaataacttgttttctggcaagcttgggatgagattccttatgatttaatcagatccataatgaagctctcccagctttcaggagaaaacatcctgaactgcagggctggttaagggcagggccctggtgaagaggaggagccccctgcctgagcagcacatttggagccaggagagctgcaacagggccatgccacccacccagtggggtgcccccattgtggctgagactcctggcagtgctccaaggtgtgtaccatgtaagctgtgccttcccactccctgcagcccagactaaaggcctcaaagataataggcaggacatcgcatctgtaaataccagctgcttggtccaggaagagacagtttcctacatatatatatatatatatatatatatatatatatatagagagagagagagagagagagagagagagagagagagaaggaggaggagagagaccaggacagacttgccctggctgaaaccaggattcccttgatggttccaaactgatgttaaattagaggataactccagatatgataacaagctgggggtggcaaagtaggtgggtaatcagggagcatctgagtaggtgacagagaattggataatgaagaagcaggtaaggtgatgggaagtagctggggcaagagggagtagccaggcaataaggcaaagtagctggagaatgggagagtaacttgatgatgaaggccaggcacaaagtgggagttactgcagtggggcaacagaagacagccccagacctggggtagaggctaccctgacctgttccagttgccttcattttgccacttccttaggtcttgctgctgagaagtaaactcagcctaagtctgtaccagttagctggaatctgggctgttgtaaactgttgtggtgaagctccctgggagtgaggctgaggttgtagcagtagcaggtaggtgtggtgagtttatttccttgagggaggggctctctcttctctcagcccctcaaaggatgggtgaggttgcctgccagaggtcctggcacaactcacatctgagcccccaatttccccatcatcaccttcatccttctctcaaccagatttttattggataacttaagcaccaggcattgtgctaaaaatctttctatgcatcaactcattgcatcctctcaacaactctataaaataggaaccgttagtaaccccatcttacaggtggataaactgaggcttaaaaagtctaacaacttgcccacataagaggcgtagccaggactgtctgacttcagaatctgtcctctaagccttatgccacagtcatggttacttctacatggagcatttctccttcaaaagctcacccctacccattcactatttaacagcacttaacaaggtctggtttgggagtgaaagctcaggtagggtgtcctggttgggtaaggagcctcagaaacaattcaaatgctcatggtccccacctacggtgggcacagccacctggctgcccttttccaaacccattgcccgtgaggtctgttggataaagtcacagtttagaatcagtcttccccagggtgcacccaccactggcaatcagacctcatttgcactgagacatttatagtccacagtgaatttccattatctatatagaatgagacaaagaaacagaaggctcctggctttaggaagtttcttcttctctcttctgtctgacagccatcctttccagcatgtcttgggacagatgccatgtcaaggatcatctagatacttggaaaatattgtataattccaggctttataattttttaattaaaaaaattatgtttggatcctgaagagcctaactgtattccttatttaatgaaagcaatgcaatcgcattgtcactggtgacatggtccctcatttaataagctgctggctccaagataagccatccattccaggaggttcttgattggtaaaattgttttgcactaaaaggagcttaaggttaagcactaattaatggaagggggttggattttatatagatagatcggtaggtaggtttggggacatgtcaaatacaccatctttgtctctgcagctgaaaatatatatttaaagcccacacaactccgtagatttcttaaagctccatttttggcaagtatattccagtcttggtgtgctctggttaataagcagcttctgactcagggcactcagtgactgatggttgcattgacccaagtatctctcaggacgcaactgatgtggtcaaaatcccccaggtggtttgagcccaccagtctttctcggtggacatggcttgagaacttcagttgggcactaggacactatcttatctgaggcggccagaaaaaaaattatagactgggtggcgtaaacgatagaaacgtatttccttacagttctggaagccagaaatccaagatcaaggtgccagaatggctggtttctcgtgagggctctcttcctggctttccacctcctcactgtttcctcacctggtggtggtttgggggaaaggagactctctggtgtctcttttaaggacactaatcccatcatgggggccccatcatcatgacctcatctaaaactatctcccaaaagtcccatctccaaattccatcgcactggggatagggcttcgatgtatgaatttgcggggaacacagtgtagtctatagcaggcactttctgtggctgggcaagacagctgtcttctctgatgtccctggggttctctgtggtgctggagaaactgatgggggaattctctggaatttgtgtcctgggtggacacaaaggcctcaaaagctcgaagcccattcccgtggcctggctgcattgaaggaaactttactgctgattggaagagctatggggtcttcagaccctgccagaacacagggcatatcattttgtaggggagagccctagtcttggaaaacttcctggtggaaagcaaaggaaaggaggcagaggaaaggaccaaacctgatttattgggtaaatattaataaatgaatgtacctagtggctgccatgctcttctggcaatgagattggaggaaggggatatgattcagacccataaaactctggagagggcagtgggcttgtttaccaaatccctgatgctacccagagaggtgcccaggaacttgaagcaagtagggatgtagaaggaacctgtattattagggaggtgtcctggttctctattgtcacatagaaaagctattctaaaatttagctgcttaaattatctcacatgggtcaggggttcagatggagcccagaggggaaaatttgtctctgctccacaacgtccagagcctgagctaggatgactgaaacagtcatcctgtagtcccagggcctccccatgtagcctctctacgatggtggccttggcagagtcagacttcttggatgatgtctcagagctccaagagcaaatgtcccaggatccaggaagccgccagtttcttgagaccttggaacagctaccaagccgaccccgacttcagtggaagggaccaagaccccaccttctgatggcaggagtttgatggtctccactggggctgtctttaaactgccatgggaggctacctgctgcggcattttgaagtttatctcttgctcatgtgacagcccagcacgggtattcatgcttacttcagcctgtgggtggggaacggggagtgactgctagtgcgggttccttttttttttggcggggtgggggagggtgtgtgaaatgttctgaaatcgattgtggtggtggttgcaactctgtgcaaccatcaaagagggcagctctcttcaacacaatgaccccatgcctaggcttcttccatcctatggctctgcccgctagatcagagctgtccaatagaaaaagaattcaagccacatatgtaactgtatttatttatttagagccaggttcttgctctgttgcccagactggggtgcagtggcaaaatcatggctcattgcagcctcagactcctggcctcaagctgtcttcccacctcaacctcccaagtagctaggactacaggcacatgccaccacacctggctgatttttaaattttttgtagagacagggtcttgatatgttgcccaggctggtttgaactcctggcctcaagcagtcctaccacctcagcctcccaaggtgttggggttataggcatgagccactgtgcctggctagtaattcttaaatgcactagtagctacatttttaaaaggtaaaaaaataaacagttgaaattaattttaataatatattttatttaatccaatatatccaaaatgtcatttcagcatgcaatcaatataaaacttattaatgagagattttacattctgtttttttcatatcttttacatttatttatttatttatttggagatggagtttcacccttgtcacccaggctggagtgcaatgatgcaatctaggctcactgcaacctccaccttccgagttcaagtgactctcctgcctcagtctcccaagtagctgtgattacagtgccaccatgcccagctaattttgtatttttagtagacatggggtttcaccgtgttggtcaggctggtctcaaacttctgacctcaggtgatcctcccgccttggcctcccatagtgctgggattaaaggcatgcgccaccatgcccggctaattttgtatttttagtagagacagggtttcaccatgttggtcaggctggtctcaaacttctgacctcaggtgatcctcccgcctcagcctcccaaagtgctgggattacaggtgtgagccactgtgcctggcctttttgtatgtttttgaaatctgaaattgatgcaccatatgttgattcagattagccatatttcaagtgtcatggccacacatggctcgtagtcaccacatggggcggtatagccctggatcctcagagttccctcattcaggttggaggtggagattgcaggggagggatctgcaggccagatctggaagtggcaagttcagcccgcattccactgaccagaacccagactgtggtcgcacctttgcaagggagactggaacagcatctagctttgtgcccaggaggataaggaagcaaggtctagcgaacactcagcagagtctctcccagcagccagcaattttctgtgcatctactatgagctagtcagcctggttggcaggctgtatctaggttttgagtaaggtggaagaaattttgctttatatactggtttcccttagctcatagttcatactccttaaagtggcttccagggtcttccatgctaacttgcttcccagtgctcccaggggccccctgcaggtcccaatttgcacactgttactcatgctcttcctcccactgggagtatccgtgttctcctccagtagtgcccatcttccctgattctccccattccctgggtcctcttcagtctcttatgctccccttttatgcccttcaccatatacagacatacaggcagcatgagtggagaaacatgcagttcagaagcagctgggcctggattccagccccagttctatgacacacctgctgtgtgaccctgaggaaagtcactcaacctctctgagtctcatctgtcccctctgtaaaacggaaataaccagagctacctggtgggatgttggcccccacctgtcccagtgctgcacagctgcaggccaaagcccaacttggtatttgagctggttctgacctgggcaggccctagaagaggatgagaccccttcccactgagggaggtagatttgatcttgtgatgagatgtccttgtctatgagttgcctgggagagccaagactcctgtgtccctccaaagtgatggctccacctggggggctaggctctgcctcagggtcaccatccaacttttaaaacctttgtctagaagaatctcagcatggttaccataggaccctgacctgtccgttttcaccctgggatgggacatcttcttcccccccacccttcagccagcctgcatcaatctgctgttgccacttgaggatctggatggtgggccctggcctgctgcagttcttctttttttttttttttttttttgagacgaagtcttgctctgtcgcccagactagagtgcagtggtgcaatcttggctcactgcaacctctgcctcccgggttcaagcgattctcttgcctcggcctcccgagtagctgggattacaggagcctgccaccgtgcccggctaatttttgtatttttagtagagacagggtttcaccatctcggccaggctcgtctcgaactcctcagcttatgatccacccacctcggcctcccaaagtgctgggattacaggcgtgagccaccgtgcctggcctacagttcttcttttgcttctggtctcttactggactcttgtgaggctgacaccagccctgaccaagcccagtctccttggaggagaggcccaagtccagcccacaactgtgtagggccccccagccttgttgcctcccatgcctggcttcttgccctctctctaggggcagggcatgctgggctgtcttcctgaagcacccagaaaagttatgaggaggggacagttaatgccaggtgaccagtgaccctgagccagtcctcattgctatgttcagaagagacaaaggcaatgttagcatagtgaatgttgaactgggctgggtgccgtgaaaatgatataaggcagaaactataaggcggaggatactattatacacccattttatggaagaggaagctgaggtgcagagaggttcagagacttgctcaggtctcacagctccgagtgctcaagttgaattttgactcaatatcacatgaatgcccccgacacaaccctaccacctaaaaactaaaaggaagatatgaaagcaaatgtagagagaatatagctagtagccagaggtaaagtgaagagtcccaaagactcagaaataaaatcactgtctgaccctttgtccagaaaattcctgacgtaatggatgggcctcatcatcccgagaaacccagagtcagagtcaggaataagcaggtccttgaggaaatgaggaatgggatgaagaagaatgttcaggagggagagcatggccacaaggttgactgtggcctgccctagggtggggagtgcaaaagcaagatcttggagctcttgggttccttccctgctctcctgcccactccagattccatcagttatggcctttggaggctgtctgatctctgccctgcttcctggctcacccagccactgcttgtcaccaattcagcttcctgggtgttctgatgttcgaaagagggtgtgtgaatggtggacgagaacatcctggtctatatgaaggagtgggcttcagggtcagtagatacaatggtccccctacttagttccctggtgcttggagaccatcgtggtgctgggtcatgaagcagagagaacatttgtgggctctcccagcccagaactgaagcttctgaaccatggtgactctaggaagcccaccacccaggagtcagcctgcctccctggatgcaagttgcctctggtgcttacaaaccacagcacaaaacacaaaaaatgtggaaatggggacgttcccagaaggcaacttcctggggctcagataaccctggtctgaccgcagagacctgatgcacctcgtacttcccctcctgtctgtgaagcatgaacttggctggtgtcatgcctctgtgactcaaagatccctgctgacaggtttaactccctgcatggctgagcccctgcagagcccaggaccactccactaggccaaagtgaggggtaatggaaatgaaaactttccacgtttccgtgtctgtctccccgtagcctgagcccacaccatctgcctccttttactctggcatggatgatgggaaggaccaggccctttccaggttcctgttctggctcctctgtacagcagctgtgtgatcctgggccagtcgctttgcctatctgcaccccaggtttttcatctgaacagtgacggtcacagtaacacccacctcaagggaattgcgagaattaaatgaacctgtggatgtcatcctagaacagtgactggtatatagtaggtgctcaatagaggttaattcccatcttttctgctggggggcccagatgagatgaaggttttctgtttaatgaaaacgtgcacaaaagcccagcagcgctattcctagatatattcccccaagagaaatgacataagtctacataaacacttgtctacaaatgttcatagccacatttctcacaatcaccccaaagtggaaacaacccaaatgtccatcaactgatgaggggatacatggaatgcagtctagccatacaatggaatatcattctgccataaaaagaaatgaaggactgacacgtgctataccatggatgaactttgaaaacactatgttaagtgaaagaagccagacacaaaaggccacgtgttctagaactccactggtatgaaatgtccagaatagacaaatctatagagacagaaagtagattaggagttacctatggctcggggtgtggtggggaatgaggagtgactgctaatgggtatggggtttctttttggggtgttcagatgttctaaaactgattgtggtgatgattgtacaactttgaatacaattttaaaaaactgaaatgtacatttttaataggagaattgtatggcatgtgaattatgtctcaataaagccgtttaaaaatgaaaagtcagggagaggaagagaaacttactagcacttgctagtgccactggcttaaattgcttcctaaatattcacccatttcattctcacaacaaccttttgggaggtccttttatcaccccatttttgcagttgtggaaacagaagcacagaaaaggtgaagtaacatggccagtcacacagctagttagcagacctggaatttgaactcaagcagtggtggtttagaactgaaccgccaccgtaagctgccccccactgcaaccagaggtcggacttcatgtataacagagggagtcacaggacctcattcacccagaaagaccaccggagtcccccacctctcacagagggatctgccaggacttgggtgcacagggtgtagggcctaggtaccagcagagagccaggctctgagaggcagacaagaagtgggtgtttctgggtgacactgtgggactaacatgtctctgacccagtttgagagtgcctggcccctcctggagctggagctgcagaaatcgatttgcagactgccggtttccacttaattagcatggcctccttctggctgggaaaacaccattaaatgggctgggttggcctggaatcatgccggtggcctcggccctggttctctggggctatctgtctcttgggctctgtccccttagccaggctggaattcagaatggcccgagtttctggtttggagtatgaggcaaattctacccacgtccaggcccaagtgttagatgatcctggggccccggttgagggaactggaaggagaaatagaggcttcactcttcatactctgcctccttgggcccattggtcagtgtcctggcacacagacctctgacttgcacagggcacctaccctgtgccatgtacactgctgcattctttttttttcttttttttttttgagacggagtctcactctgtcgcccaggctggagtgcagtggcgcgatctcggctcactgcgagctccgcctcccaggttcacgccattctcctgcctcagccttccgagtagctgggactacaggtgcccgccaccacggccggctaatttttttgtatttttagtagaaatggggtttcaccgtgttagccaggatggtctcgatctcctgacctttgtgatccgcctgcctcggcctcctaaagcactgggattacaggcgtgagccgccgcgcccggcctgctgcattctttagatgcgtcacctggtacaccttccactcacgtcctgcacaggtgggctccacttcacagatgaggagacagaggtgccgaggggttgtcacttactgaatgttcccatggcagtaggtggcagggccggattcctatctccgggtctcctgcttctggtgtaatcccagcggcccctgcagagcctgcctctgttttgagggcaccactcatcaccttggctttaaaaagttgaaaagtggccaggggcgatgcctcacacctgtaattccagcactttgagaggccgagttgggcggatcatgaggtcaggagttcgagaccagcctggccaacatggtgaaaccctgtctctactaaaaatacaaaaattagccagacatggtggcgtgtgccagtaatcccagctactcaggaggctggggcaggagaattgcttgaaccctggaaggagaggttgcagtaaggtgagatcatgcccctgcactccagcctgggcgacagagtgagactcttgtctcggagaaaaaaaaaattaaaaataaataaataaataataaaaattcgagaggtttgatttctgcttctggtttcagaggaaggaaaatcacttaggcaatgggcccctggggaacagaatagctcctaaatcccgggtgtgctgtcctctgtgggctgagtgtctgtgcagcgggaagaaggggcacctctgggttctaccccagacttgctgcatgaccttcagcaactgacttgatttctctgagtctctttccctcatctgtagaatggggcacagtaacagcctcctttgcaatgtggatgacacagaatgccccggaaggtgcgttgacacatggtcagcgtcccgtagcagctgcctgttatctcgccagcactcttgtggctagcccttcagaaacgaacccaaagaaggcctgcttgctttttctcacaccatggatgtctggggtgtgaggcaaggcacatctttttcccatggaggggatacagcccgccatgcaggagatggcctgggatggagggtgggtctcctgggcctggagctcagcctctgtctggtgatgtcaggaatctgcactgtggagcagaggcaccctgcagtgtgcaaagtactggtgttttcttttaaattgaggtaaaactcacaaaacacaaaattaaccatttaaaagtgtacaatttagtggcatttaagtaccttcacaaagctgtacagtcatcacctctgcttagttccagaacattttcattgtcccaaaaggaaaccctggactcattagcagtcactccccagtttcctcttccccctagcccctggcagccgctaatctactttctgtctctatggatttatctgttctggatatttcatataatatgtgacttttcgtgtctggcttctttcacttggcgtaatgtttttcgggttcatccacgctgtagcatgtgtcagtacattattccttttacatctggatcatgttacattgtgtggatagaccccctgtcccccgccaaccacacacacccaggctggagtcaccctaaggtccacctctgcagtgatggttaaagcgatgtccccaaagggcactgtggtcttggctccttgatctcaccagccattcatgtccaaacatcagcctggtgctgatggggacgaggtggggagtgattctgggggatggggatagttaaagatccaccagggacagatgagcttcctgtgtggtccaactcaggagtcaccagggtccatggttcagatgctgggatctggagcgagaccatctgggctcaaatcctagctctgttgcctattgggtgaacttgggcaaaccattcaatctctctgtgcctcagtttttcttttggttaaatagaataataatacactacctacttaaaagggttgtaccagagctaaatgaagccttgctttagcacagtgcctggcacagaggaatatttccaaaatatgttagttgtccaaaatgtgttagcatttccaaaatgtgttagctgtcagctcttgtgattctttgattcttttttttccccccgagatggagtcttgctctgttgcccaggctggagtgccatggtgtgaacttggctcactgcaacctccgcctcctgggttcaagcaattctcctacctcagcctcccgagtagctgggattacaggcgcccgccaccacgcccagctaatttttgtatttttagtagagacggggtttcatcatgttggccaggctggcctcaaactcccgacctcaggtgatccgcccatcttggcctccctaagtgccaggattacaggtgtgagccaccacacctggccgtgattctttgattctatcagttggtgtttccccctaaaattgcagtcctgtgagtgtgctgaggccgtgcctgggcactatgcaccctcatagcatgggttgccttttcttactgctcctcccctgggctgttttccatctatttcagggctttcttgttactgtgcatcactgtgagctccacagagcaaaggctcactctggtttgctcagcacagtgtacacgccgggcacagtccctctgaacaactgcatgcccacaccactcctgcgtttcacctcaggaccccatggcccacccctgtgagctaagctcatgcctttttactttgagataattatagatttacatgcagttaaaaaaaatacagagagatcccttctgttctacacccagtttacccaaatggtaagttttttttttttttggagacagggtctcactctgtcacccaggctggagtgcagtggcgtgatctcagctcactgcaatctctgtctcctgggttcaagtgattcttctgcctcagcctcctgagtagctgggattacaggcacatgccacctcgcctggctagtttttgtttttagtacagacggggtttcactatgttggtcaggctggtcttgaactcctggcctcaagtgatcctcccgcctcagcctcccaaatggtaacattttgcaaaactaatatatgttatcacaaccagtaaattgacattgatacggttcaccaattggatccagattttgccagttttatatgcattcatttgtgtatggatgtgtgtgtttggctctgtgaaatctttgatggcaggagcagatttgtgtgaccagcactgcagtcaagaggcagaattatgaaatactggttacatgataaaattataatattttggacatatggattaggtaaaatatatcattaaaatatcacctgtttttattttttaaatgttgttaacaaaacatttcaaatcacatatgtggcctatgttatatttctctaggacactgccatcagtccaaaaagttcccctgtgtcccttcccagtcaatcccctacgctcttccaggcagctattgttctgatggtttttttccccactaaaggctatttttttcctttttgtcttttttttgaggtgatatgcacataaaaaattagccattttatttttttttatttatttatttttgagacagtcttgacgtgtcacccaggctgaatgcgggtggcacgatcttggctcactgcaacctccacctcctgggttcaagtgattctcgtgcctcagcctcccgagtagctggaattacaggcgtgcaccaccatgcccagctaatttttgtatttttagtagagatggaatctcaccatgttggtcaaactggtctcgaactcctgacctcaggtgatccacccacctcagcctcccaaagtgttgggattacaggcgtgagccaccgcgcctggcctatttttaactttttggagaactgccaaactgttttccacagtagctacgcaccattttatatcctcaccagcagtgtacaagggttccagtttctccacatgcttatcaacacttgttattgtctgtttttaaagaaattatagtcattttagtgggtgtgaagtatattgttagtttgctttttctggaaagtcatgcaagtggaatcacatagtatggaccctgtgtgagccttcatttgctcaacttatatgcgaagattttttagatgtgtggtttgagggcctggaaagtcatgtcctggcctatggaatatattaaaggggaagataggattccttaaggcaaaagtggcagttcattaaccccctcccctgcaaatccctgccccacccccatcccgctgccacataaagatggacctgtctgcctgccttcactgcagagcaaaaattttatttatttatttttttttttttttaagacacggtctctctctgtcgcccaggctggaacacagtgacgcgatcccagctcactgcaacctccacctcctgggttcaagcaattctccttcctcagcctcctgagtagctgggattacaggtgcccaccaacatgcctgactaatttttgtatttttagtagagatggggtctcaccatgttggccaggctggtcttgaattcctgacctcaagtgattcacctcaagtgatccacccgccttggcctcccaaagtgctgggattacaggtgtgagcaaccacgcccggcctgcagagcaaaaatttattgagcacctgtggtgtgccaggactcatttataagtaaatagaaaaggtccctgtccttgtagggtttataaactatagggggaaactacaagtccacatacacataacctaccatttaaaagtctgactaaatgctgtgaaggagtaagcaaggtgctttgatagggaacagagggacagtgtgtgtataggaaggccagtcaggtgggtccctctgaggaggtgacacttaagagacctgaaggatgagaactgagccagccatgcagaaggatggggaggctgggctagaggagagtgttctaggcagaacaaaatagcacaagcaggggccctggggcagtgaaagcctctggtggttcagtgcaaagttaggaaggtgtgaaacagtgggaagggaagggacagggatgctcctgctggctgatggcccatactgtaggggccacaactttgtcttagctgcaagcaggaccggagacatgaagggccagactctgggccaatttccttgctgcgttctcagctccaagaggcagctcggctgggatattgtggctcattctagtgtcttgcagcctctcaaactggagggctggagggttggggcgtggttagtggcagctgtgacggagacttatcaggaagcaggcatgtaattcctgcagtgattcacacccagtccccagtttactgcagtcctgcagtgattcacacctgggccccagtttaccgcagctgcacctttaaacagggctcggatgcctgcatctccctgacccgtgtgtaccctcatcatcccaggacctcggaggtgtgggtgaggcagcacatagctcagcctggtgccctcctctcactagagagcttgaccctaaagccgcaagctcaagcccacgccctggccaacctcctggagctttgagaacaaggtgtcctgtacacagagtcctggccccagtacctgagcgcacatgaaccccgtatgcaagaagaaaactgaccccagccccatgttacataagaacatctttggaatttggctccttttgaaatgaaatgggaaacctgcactcaaacaagcaggtatggggaattcaataggaggcaaatgccctcagggtcacctctgggccagtatgcattctgaggattggtttattcattcagcaaacattgtggacacctgctttgtgccaagcttcatggagggatacaagaacagatgttcaatcaatgtctgtgggaagaaggagagagaagggggatgaaagggaaggattgagaaggaggagtgtagggaggtagagagtaaggaagagaggaacgaagggagggagggagggagggaaggaaggagggagggaaggaaggaaggagggaggcaaagaaaggggaagggagggagggagggaaggaaggagggagggagggaaagaaaggggaaggaacagagggagggacggagggaagataaatgggcagagataccctcacagagctcatcgtcatgtgactgtgggtgcaggtgtgcccatggtaatgtaactaagtatttacaatctagctcagctctgatcaatggaaaaataatgtaagccacatatgtaattttaaatgttctaatagttccagtaaagcaggcaaggaacaggtgaaattaatttgaataattatttaactcaacattatttcaatatgtatttagtataaaaatattaatgggtatgttacatatctttttcacactaaatcttcaaggtcacccctagcacgtctcaatctggattatgcacatttcaagtgctccccagccctggacaccgtggagggtggcaggcactctgactgaggtgcacagagcctgctgagggcacttaagtcagagtcaaggaagacttcaccgggtggtgccttcagtcatttaatcatttgctcacttactgttcacctaatgtttattgaatgcctcctgcactgggtgtgacggctgggcagagactctgcttggaggaaggagggaagggcattccagactagggaagcagattgcaagctctgagagggcagactggcgtctgtctggttcactgctgtagccctgcacctggtgcagagttggtgcctggcgaacatttgcggagcgggaaaggagggagagaggagttgggcatttctagagcgcaggaggcagagaagactggttagagaggaagctggagacaccattctcaaacttgacagtgcactggaatcactggcagggtttgttaaagcgtagattgttagacacccccctcctgcagggttcctgatccagcagggctggggtagggccaccggatttgcattgccagcaaattcccaggtgctgctgctgctgctggtccagggatcactgagaaccactgggctagaccacgaaccctgtgaaggcagagaggagccaggagaggtttctgagaaggagagaggggagcacttaggtttgtgatttagaaaactgtgggtgtgcggcacggtggcgcatgcccgtagtcccagctactcggtaggctgaagcaggaggatcacttgggtctgggagatctgggctgtagtgcgctatgctgatcgggtgtcggcactaagtttggcattaatatggtgacctcccgggagcggaggaccatcagggtgcctaaggagggatgaagtggcccaggtcggaaacagagcaggtcaaaactcccctgctgatcagaaaactgtgcatggctgctgaggacaggggtttccacctccgtcccacctctcctgccagggcagtggcacccttagctcaggagggtgcgtcaggacccagttccatcctcacacggtggggaagcctgggctgtgctcccagaacaagaaacagacctgggtgatgagtgacaaatgtggacggttctctgcactgtgggtggaaatagaaacccttagtcagctgtggggttcagcaaagaatttccctggttaacggaaacttgactggctgtgggtgagggggaggttgggttctgagacgtctgggaggcctgggctcttcggttctcgtggtgcccagctcagcgtgatgccttcaggtttgagaccacttcctcctgttgagcctcttctctgggggcactcattatgtatgctgcgtaacaaatcaccccaaaaggtgttaagtgaaagtaacaacagatgtctgtgttctcacagtttctgtgagtcaggaacccggggtcgctgggtggtttgggctcagggtctctcaggaggctgtcgtcaatatgtgggccaaggcctgactgggttaggggatctgattctaagatggcgctcacacgctgttggcaggaggcctcactccctcactggtggtcttttcacaggactgctaagtccacactatgacagctggctttcccagaacaggtgatccaaggggcaagacagaagctgaaacatcttttttttgtttttttttttttgagatggagtctcactctgttgcccaggctggcgtgatctcagctcactgcaacctctgcctcctgggttcaaccgattctcctacctcagcctcccaggtagctgggattacaggcatgtgccaccacactcggctaatttttgtatttttagtagagacagggtttcaccatgttggccaggatggtctcaaactcctaacctcaggttatctgcccgcctcggcctcccaaagttctgggattacaggcatgagccaccgtgcctggccagctgaaacatcttttatgacccagactcacaaggcacactccatcctattggtgacacattagccctgttcactgggggagggaactggacaagaaggtgaatcctaggaggctggggtacttgggtggcatcttggagactgaccacaatgcccaaactgccctttggccttatcttgtagtcagtccacagatctccaaagataactgtatctggtgctgctatttgttgtcttggagcttgaagactgggccctacattcctgaggggtgcctgctggagccaggaggtggggtaggggagagccagctagtagctaaacactttactcattccagacactatggtcagcactttataatctaattctcagacaaccttatgagattatagtccccattctacagatggggaaactgaggctcagatagaggagatgacacatctgagatcaaaccactgggaaatggtggggtctgaattctgaaccactacacgtgtgtcttcataccaggtgcaatgcttaggtagactgcatattccccaacagtgtgctttgatggcttctctccagggtggaagtggttggagcaaaggtcagactggccctttcatcccttgggctcagagcctggcactaggcttgctggcagaagaggaaacaggaaggctttgggctgcatgcagatccccaactcttaaaacctggggtcaagtttggctctctcatacattctcatggtggagcaagcatgggtcaagtgtgggggtattggagcctcttaccagctgagtagattggggcaagttaattaaactcactgtgcctcagtatccccaactgtaaaataggagctcattagagcctgcctcacatttgccttgggctgttgtaagcattaaatgagatcatttcctacacatgctagactcagggctgggcaacagcaagtgctcagtaaacatgagctcttcttatcgcaggcttgttagatgctgatatgcatctgctgtctgttcccacatctggctgagctgtgaggatacgagggttgaagaccatggcatttttgtctattgctgggagcatcagcaaatgatccatcctgcaggtccgagagctcaggacattttcagcaaatggctcccaagtcccatacatcactctacctacatcctgtcctggtcctctctgagccaggaacagagggttccagaagccctggaaaacttgcagcttgctcccctccgggcccagccagctactctctagctgttcctgtctgataagagagtggatttttccatttcctgcagcagaaatgctcctgtttcctctctgcccacccagctgccctggtttctgctgctgcacgggcagaagatgggtatctggaagtcacaggagattgtgcagcatgcagggagagtagcaggacagggccccccaggcaggtggggctgcaaggcagtcagcataccttgcaggagccagacttctctgttttgttttgacatgggaaccgagtctgtatcagaaatgacaaaatcaaacacccgcaaacaaaaccccccagcgaagcaaacaggaagcagggtctggataaaaataccatcctttttgcagctgcagcctccaccatgcaggtttcagaaggtcacgctcttgacaggaaatgtggctgctttcagaggggagaggtggctgagttggggccgggggtagagacagtggggacagccagaagcaacagcaggctctcgggggaggttcgtgcacctttcacttcttgacaggtgaaggaactgggcccgatctgtctgttcccttcctggccacgatcccagggttcaccttggacttatatttgtttcttcctctcctaccagggaccaggagacttttattgtgagggtgaaatgagactgtggttttgaacttttttttttttttttttttgagatggagtttcgctcttgttgcccaggctggagtgcaatggtgggatcttaactcactgcaactccgcctcccgggttcgggcgattctcctgcttcagcctcccaagtagctgggattacaggtgcctaccaccatgcccagctaaatttttgtatttttggtagagacaggtttcaccatgttggccaggctggtctcgaactcctgacctcaggtgatctgcccgccttggcctcccaaagtgcttggattacaagcatgagccaccactctcagccattgaacatattttgttagctgaaaagcattaccctgaggatcagcaaagtttttctgcaaagggctagataagaaatattttcggctgtgtggccatatggtctctgtctaactcctcagctgtgctgctggagcctcaaaacagccataggcaatgcataacaagggagcgtgtgttccaattagtttttggacactgatatgccactttcatgtaatgttcatgtattgccaaatattactcttctttgatttttttcaaccattaaaaaaaaaatagaagccattctcagcttgcaagcagtataaaattaagccagatttggtttgtagaccacagtgtgccaacccctgcactctccaaacaaaatggtttgtattattgttgctatttaacttcctactcaatacaggaatcccagctttagcacttccttcatggggtcagccaggttgagactttgtttctgcactagctactttgagcagaaatagagttcttaccacttggctatcattctgcggaaggtttttgttttttagtgaaattgagaagttctgattataaaggtagtacatatggattttaaaatgcttgggaaatactggcaaacacaaaataaaaatccctgataaatcatagctactgtattttttttccaatgaaaagtgtgtggatgtatggaaagcatttttttcctttccagttgagattccattgaatgtaaagttttgactctttgtttttccattctatgttatatatcaagcattttcccatgtcattagaaattcctcaaagataccagctgcagaatattccattatatggatgtttcataatttaccaaatcaacctccaattgtttaggcatttgggttgcttccaggatttctcacttataaacaatatgcatataaacaatgctgctgtgaacatccttgttcgtaaatctttgtctgccctctgatcttttctttagggagaatgtgtgctgaaaattcctaggaaaactgtgcttctgacttatatactaacttttttttttttttgagttggagtctcgctcttgttgcccacgctggagtgcaatggtgcgacctcggcccactgcaacctccacctcccaggttcaagcaattctccacctcagcctcctgagtagctgggattacaggcacccaccaccacgcccggctaattttttttgtatttttagtagagatggggtttcaccatgttggccaggctgatctcgaaatcctgacgtcaggtgatccatccgcctcgggctcccaaagtgctgggattacaggtgtgagtcaccacacccagcctatactaaccatttttgctttactgaatttgactttgctgattatgcagttcataaggtttcctcactgataatgacttcattctcccctcctgcaccgctagccccaggcgaccactgatctgctttctgtttataatttcattttgaagtatctcatttttgatcagcctaaagttgattacctccttatttgctcagaattccattcttcataatagtaatgctgccacctccactttctttgtgtttgtgtttgcctgttttatatttgaacattcctttaattttagtctccgttattttgtttggaatatatctcttgtaagcagcacacagttgtttttttttttttttttttttttttttggcaaccaaatcattgctgctttatgggaaggataaatgattcaatttactcatctggtacatgtttggatgtcggtcatcttgcttcgtgatttgtggcatttatttcttttattatttctttcattttgtgactttaatgaatactgtgttgatttgcatttatcttttccatcgataatatggaagatacaagtagtgacttcaatttcttatgtggttacctttaaaattttcagaaatcttgttttatttccccaggcagacacttgttcatgtcctatgtaatacagggctgaggcagagtagcatctttaggaaagaccaaaattgaaagccaaggcagagacaggggaggtagttttgggacagcagaacaggaccagggaaatcagagggaagcttcagagtggacaggtgtgagctgaaggaacttcccccttcatacacagcttgttgccttttcctaaacattgataggaatggattttattcttggctatatttgagtgagggtcccttgtaattagtcatgcctgaaataccagttatgtatggaatcaaccagactagaatttgagtctcagtgcttactagctaaataatcttgggaaaatcatataagttatctgtcaaatggtctaataatagcacctaagtcatgtggttgttgtggggattgaggcatcccagggatctgggataatacatgtaacatcctggtacagtgccttatacttggaaaatagtcaatgaatgttagatgctattatgatggctgtgaagctattacagtgtttatatgcatgtatctcctacctgcagggctggaaatatttttatctattacttgcctggagatataaagtaaatggactatttttaaaaattcaggattgatagctggaaggagaagtgaggtgagagatgggttttagagagcaagagcgagtcagaaagaggcattcagggcatctggggagaggggaattgggataagagcagataccttggagagctcccggacggccagtgcgtgtttaggcgggccaggctctgcggagcggaagggagatcaggtccctaggtctgcagtgaagctgtaaggagaggtgctgggagaattctggaggtagaatcagtaaagaacaggggcctggtgcagcgggggtctgatgtatttatgaatagaatgaggaagttccaagttcgtgtttctggataagggggacccttgccttcagtctctgagattaagtacagtgaggggtaagagaaggggaaggaagggagaagaagagagagggaagggtccaaggcacacagtctttgcagctttggtggagaaatcttacaggcccatatcatcttcacggtagctgagttaaatgcagttctccctccctttgaggaaatcgaatacacaaatgtcccctcacacattaggaagtgattccccacctcaccccaacctccatgtgtcagaaagactatacatattgaaaaagattaactgcaggcctactttgtacatcagttttctgggtatctttagttttttattcttagaatttaaaaaaatatttttaatttgttcattcagtcaacaaatatttgttgagtgctttctctaggagctgcatgccccacataagaagacagacacgagttgcccgcatagagcttatatcctaaagggtgtgctgtcacttttcctgcatacacccaatgccagatgtaagttacatgtgcagaggcatctgggtagctgatgtgaatctctgtcaaccccttctgtctagcagagacatatgtcctgggcacagaggttctagaagggagcaggtttatagctacgtgtctggggtccccttggccatcttgtcctggtggtgctaagggtgtcagagatgctaggagaggaactggcctctttgttcaagccaaagggtgaagattctctctgacaaggaaaagtctgtggcccagcctgggaatgctcttgtccaaaggaagaagcatagagtagctcaagaacagatgttctggctggttctgaggcttgggtagaggccaggtaagctccattcacttctgcggtcatcagaaattgactgggggcctgaactacatcacaggagcagcacggtagccaaaagatggtcctactcaccctatccctccagaactttagtgtcgtaaagacacagacaaatccatacataactataaaatagtgttaagtctttttggagtttgggaggcacagcagtcatatgagaagggtgcctggcccagcctgggagacctgcaagaggctttgcagaataaatgacattgaagctgggacttggaatctaagtaagaattaaccaggtgaagtgaagacagagaaagacaggcagggctgggtgtggtggctcacgcttgtaatcccagccctttgggaggctgaggcaggaggatcacttgagctgaggagttcgagaccagcctggacaacatggcaaaatgccatctctacaaaaatacaaaaaaaattagctgggcatggtggtgcgcacctgtactcccagctacttaggaggctgaggtgggaggattgcttgagccctggaggttgaggctgcagtgagcttgatcacaccactgtactccagcctgggtgagagagggaccttgtctcaaaaagaaaaaaatactattccattgtatggaattttgtttatctattcattagttgatggaaatttgggtattactttagagatatcgcgactaatgctataaaaacattcatatgcaaagttctgtgtggacatatatgttcattcctcttaaatatatacctaggagtagaattgctgggtcagatggtaatgctgtttaactttttaaggacctgtcagtctgttttccacagtgctgtgccatcttacgttcccaccagcagggcccgagggctctgatttccacgcgtcttcacacggttgtccaacccctcctcttcttgaatgggccaagagtgatactttctatctggggaagagcaaggggctggctcctgggacctgaggcttggtcctggggatgtgactttgagggaagcccgtgtctttctggtccaccagggtgagtcatcacccaggatcccgggggagctgcctggcagaggggcgggctgcaccagccactgcagaaaccaccatgcaacttgactgagtctccaccctcagctccaggcagccgggcttccctgggagcagctatttctggctatttctgctccagggaggagcagtggtgggtggaaaggtttcaattgctcagtggggtgatttttggaagcgcagtgccttgggggcacaggacagctttgacttgggaggagagcagaggggctgctctgagagtgctggccctttggcgttatcagagcagagggctgggcacacagcagtcctgacagcaccttgaagagggggaaataagtcagtgcggactgggctgttcatgcaggaggtgcaacccagtgggcgggatgtggcgacatcaggcaggccaccagggtgcttggaagcaggggcaggctggggtctacctacaatggagatgcagcagggagaccgacagaggtggcgctggacctcaggctcagtgttcacttctgtgcctcagtgacttcatttgcaaatatagtaaccacaaaggctgcagcaatgcctgttggcaactgtcttctctatcacatgatgttctggaacactgacctttattggcaatgttcttgacctttctcttagctttttgccatccctgtgggctctcttcatgataacatctgtgtccatcctgttcttctctccgctgtatatgcttccttccctgggtccttgtttggtaccattttagcaaagtggttaagggttcactcttcggagctggctgggcctgggtgaaaatcccagctctaccattcccagccaggtgtctttgggcaaatcatttcatgtatgcaaatctgagcctcagttttcccatctgtaaactggagcaataatcgcagggagctatttaataacagcaggttacttatcctcgtaactggattatgaggactaattgacttgatggatatgaagggcttaacacaatgcctggcacacagttagtgctgggctgtagaaagagcaagggcacagggcagagagaatgaggagtgggatcctggacagagggacatgttgagtcccctgtatccagcctgcagagggggacagtgttgggtggggctgaaggactgctgtggtcagcctccaggtcaggtggtgttgatgagggaggctcaaggaagggtgtctgctcactcatttttttttaagtttgttgttgttgttgttgttcttgttcttgttttaagagacagcatcctgctctgtcatccaggctggagtgcagtgatacaatcacagctcactgcagcctcgaactcctggccttaagtgatcctacggcctcagcctcccaaagcattgggattacgggtgtgagccactacatctggcctcactcgattttgtacaaaagtcacaatcattgctttttattcctgagtcatactcctgttgtgccccatgtctgtgggactacactgacaaatagtttcatgccctcaggaacaagtagctccatgggtaacaaagtaagtgctgctgtaaaggacaaaagcagaaatgcagggtagtgtggagagaatagatggggaagctcaatggagattagggcaatcagggaaggcctcccagaggaggtgacattttggctaaaacctaaaggatgaagaagagtttgccagcccaagaatgggaagaaagaaggctccgggcataggaaacagtgtgtgcaaaggcctggaggatcagagctcggtttttgttttgttttgttttaggaaatgagaggccagtgtggctgaaccagtgagggattcagggagggatttccaggtaaggcaggtgtggagcaggcagggactagatcatgcaatgccttggaggcagtgggaggatgaggcctcattgctgggcactgggcaggaaaggaaggaagagagataggagggcaggccttgtgagtgaacctgaccctgcaagtcacatggcgaggtggcagcagctcagccccagggcaccccccggggagatgcagcttgcccaaggtccacctccactgggcagacacctctgcctggctgtctccgtttccccagaggaggagcaggagccacgcctatggtcgcatgttgctaaccatctcgaggtcaggaagatgctctgtgagacggagtgggtcagatgccaaagaaaacacaagcttgtcagcggtgatgtctccctgcaaaggcagccgccaccagcttcctgccgagatgggccggctcagcctcacttgctacagctggagatggagaggaccagatggccctgtttggcccagattccagccagattgccagggaggtgtaggcggagcagcggggtcggcgccaggagcagggatacgtgagtgaggagggcgggagccacctctttgccatctcagtagggccctgcctgtgtagggggtggcggggcaccgactgtggccttacagtggtctgtgaaccagcatatgctcagagctccctggagggagactgcctctgtcttttaccaccagctctaaagctcttgagaggtgcaagatgttgatggttgtattcccagcatccagcacagggtggcacacaagcaagagctcactggttgatttttgtttttatttttaaaataaatgctaacagtagccagggccttgtcttccttaaccccacagcaatgccatgagggagcactgttgtgatccccattttgcagatgaggacatggaagcagagaaggggaataacttgcctagagccgcagctaagcaaatgcatgagaataaatgggtcactctgacaaactgatggcagagcctgggacttggggctttgtgggcaagaagctgccctgagtgtgggcaactgagagaaggtgtggacactcctggccgaagggaataagcgtgcctttctcgtctttgtgctccctgagctccaggcaacaccttagacccaagccagcttcctccattgctccaggtgctccagagagcaagagatgagccgggagaggtagggagacaggacccctggcgtggctgagcaggctgcacactgcgtaattccagggcactgtattcacacagactatgatgagaacagtgcaaggtactgttatgcaagcgtatttgcatattgccttggaattatgcaaggcagtagctctgtaggcggaaccacaccatacaggactttgaagaccaggggtctgcaaaccttttctgcaaagggccagatagtaaatatcgtaggccacgtgagccatacagtctctgttgtacctactcaattctgctgttggagggtgaaagcagtcataggtgatatgtaaatgaatgagtgtggatgtgttccaataaaactttatttgcagaaacaggctgcctgccagatttggctcacaggccatagtttgtcagtcccaatgaaggtcatggaaggattttgaacttcatcccaagggcactgttggggctggacgtggttgtgcgtgcgcctggagtctcaactactcagaaggctgaggtgggaggattgcttgagtgcaagagtttgagtccagcctgggcaacatagtgaggccctgtctcttaaaaaaagaaggcggcggacaggcacagcggctcacacctgtaatcccaggattttggggggctgaggcaggcagatcacgaggtcaggagattaagaccatcctggctaacatggtgaaaccccgtctctactaaaaatacaaaaaattagctgagcatggtggcacatgactgtagtcccaggtacttgggaggctgaggcagaagagccgagatcgcaccactgcactacagcctgggcaacagagctaaactctgtctcaaaaaaaaaaaaaaaaaaaaaaagaagaagaagaagactgggcgtggtgactcatgccttaaatcccagcactttgagaggctgagatgggaggattgcttgaggccaagagtttgagaccagcctggtcaacatagtgagacccccatccctatattaaaaaaataataataataaaagaagaagaagaagaaaagagcagaatggagccacgagaaggttttaagcagggagtcagggagccaggtttacattttaaatggccctgaaagagctaatccctcagcagggcaacaccatttcttctgtcccatttgtgcatccttgaactcttctatcttcaagtagaggcttggcctgggattgcagggcgtctgatacatagagagttccagaagcaaaggtcactgctgtccatttcccattaccctcgtccccaaatcagctgtcagcacaggtctcgacgtggcagaaatccagaaatgctgttcctattcctggccttagggcagagtagaatggtccactggccaccagcctgggctttgaaatcagagaggcccggtgccaaatccctgctccttaatttggccacatgtgactaagctacatcttcctggccctctgtctcttcttctgcataagaggaataattataggtgtgaactcataaaataaagtggttctgaattgaccgaggtgcaaataaaaggcttagtaagaaaacattatttttatttatttatatatattttttgagacagagtcttgctccgtcgcccaggctggagtgcaatggtgcagtctcggctcactgcaacctctgcctcctaaattcaagtgattctcctgcctcagcctcctgagtagctaggattacaggcgtgcgccaccacgcccagctgatttttgtatttttagtagagacagggtttcgccatgttggccaggctggtcttgaactcctgaccccaagtgatccacatgccttggcatcccaaagtgctggaattacaggcatgagccaccgtgcctggccagaaaacattattaatataataataattttcttactgaactctagaggcagggagcccggttgtgcactgggcgccgaggactttgctcctgtgagtaggtgcagagccaggccttgggctcctaggtacattggaagtagcactgctgaggcagccttggctcatgagtactaagggcttcctagagatgggaatcatttgtcccacctcttgggctgaaaataactgcccaacatcagggtaattacatgacttggattcctccaccgcatggagaacaccccaataattactgtgcacaaacactgcttttggcagctgatgcttattttctgcctccaggagtatctcctggacaggaagcttattctgctacccaccccatgggatttgaacccctagctaatgtgagcagaaccatccagaaacccatcctagtcagggatatagtggccactgctcctctcccaaaagccatctgtaatgctcagggcacccccactcacccgtgggcaggttgggccttggtgatcagtggctttgccataatctcctacatggtcctgaggctaacaccaggcactgggtctgtaggagatgcctgcgagcagaggactgcctgctacagacatgagtcttctggagtcagcccttgagggtgatctgctttgctcagtgatggagaggctttgtccttggactgaactagagggctgccaattgggtcaaggtcctagaggagttcttgaggactcactgtgtaccaggctttagggatagagccataagtaccaggtcatggttctgcccttgtggggcttagtgtccaatgggcagatacactcaaagcccataattagttatataattgtagttgtgacaaggctgtaaatgagatgtataggagctatgggtatatataacaggagcctggggagtttaagctgagacctaaaggacgaggagtggggcaaaggtgtgtgtgtgtgtgtgtgttagtgttagaggcagatgcatggatgatggtggttggatggatgaatggatgctggtggatggatggatgaatgattgagtctcccaggcaatgggaacagactatgcaaaatctcagaggccacaagaagtgatgtgactctgtaactgacaaaagactattgtggaaagtgtttggagtttaagaaatgagagtggtgaggttagcaggtaggatgattgtgcacagctgagcaagttgtgtactggacagctccagaagatgccagtcttataaaccatgatgtggatggtgccacctagaattgtgcaagctagagacctgcagacagggctcacatcacgcaagaacttgtatgccataggaagagttgtggactttattcccagagcaatggggagccatggaaggattttaacaatttgtgacagagctaattttcatttataatgccccaaagcagcaccgtccaatagaactttccaagaagatgaaaatggtctatttctacactttccaatatggtagccaccaaccacttgaaactgagcacagcatgcctgagaaactaaattttgaatgttaattcgtttaagcagccgtaatagccagatgtagctagtggcaccatgttggtcaggacagcgccaaaggatctgaccgtactggacaaagtcctgtcatgcttaacccatactggctatgcatactgggcaggtctactggagatgccacctcttactgggtggtgacctcaacctccccttcacgcagggcctcggttcacactgaggcctagggtgcaactgggactgtggtttgggagctgggcctcatgaggatggagctgaggggctgtacccccaccccatccactgctcctgagcccttgaggactcctcccttgcctaccagcttctttttcccctggcaccccctggagttgctgactgggtttttttgtcctgcagaagggatagtcttctcttcaccctgcccagctcacttctaatttgtttccccacagcagaaatcaacgaggaaaccacctcagccctgccctatggcatgaaccgtagcgtggagatagtgtccacggtggggattaggggatgtggactttggcttctgtttcacagggagctagacttggctgggggtgggaggaggctcagagggctcagggccagcctatgtatcctgtctgcagtgcctgggcctgcacgcctggcttcatcagcacgatggcacgagggccacccacacaagccagcttgtgtattcaagttcgtccacttgccccacaaacagccaccctctgttcaccactctggcctagaggtccgcttgcccagtaactgcacagtctacctttgggaagctggatccagggaagatcctattgaggccctgcaagcaggctcggagtcatttggacagggacagtagaggtgtggcctggaaggggagccaggggcttgggtggactcgtcccactggccccctggactcctcatccacggggagaggcaaagctggagggcctgagatcaccctgccaaagccagagctggggtcccagttgccaagcctgggaaggggcctgcagggctggtgggtgagctcctctcttctctccctttgcacgtgggttcaggggagaattggggcttgaatggtggtgggcagaggaggagggaggagggtcacagtgataaggggagggggcttatcctaagcaagagggattccaggctgtcaatgctgttcactctggcctccctgcccacccagaatccctgaacacacacacacacacacacacacacacacacacacacacacacacacacacccctagacaaaattctagggattggggatggttaaaacctctgctaccctccttccccagggctcagtagggccaaagaaggggcatttgacacccataggtgagccatcacctgctgtggggacccacagttttagtaaaaatcatcacatctgccagagcaggagttcaccttcaaaccacatgctggccactgtgctgagcccctggcatggctcacctcgatgaccactcacactgctactgtgaggaggatgaacatcatccccattttgcagatgagaaaactgaggcacagagaaggaagtgtcttgaccaaggttgcacagccaatgagaatggtgcccaaatttgaacctccagagtgtatgctttcaatgactagaatgtgcatcctctggacaacaaatataacttgcttagctcagtgcctggcatccgggaagtgctaaataattgttagttcttgttattgttatccataataagataggcagtggcatctacctcttggaaattctgggcgtcagttgtctcatctgtaaaatggggagttgttactacattcttcataggcctgggggagagcgggtcttacccgggcccctgcatgcctgcacacccagtgtgcaacgggaagctcactcctgtaccctcctattgcagtacgctacttcctgaagaataaggtcagccctgatttgtgcaatgaggacggactcacagccctacaccaggtaaggccgggctcgttggggctccagggctccctgcccctcacctggacaggtaccctgtttctcggcactttcctgctcagaaccctcagggaggagggaatgagggagggaggaggagctgcagctggcccatctgaaaggctcttgtctactttggagatacgcgtgtctgttactgccatcccacagagccctgtgtgcgcccgcagacgcgactgcacatgcaggctctaaggacagggagcctttgttcactgcatccctcctgcccatgaaagcaagtgtgtttggagcttgacagtgtacgaagcacattcacacttatcaggacatcccatccaccctggcgacagaggcagttggcgggacttatgtgacctgcctgaggtcacatggtcttgatttatggtcttgagccatgtgctatcatgacatgtcctttccaaggcagagtgatgggtccagccctccctgctggggatggcttctctggctgtcacctttcacgtggatgctgctacagcctcgtaactggtccccagcattcagtctggctctgccataattctctgtccacgcagcagccatggggatgcttaagccaaaaatctcttcctgttactcaaagttctctggtgtcttcccataatctggggataaagaacaaactctgccacagtgcacaaggctgcacgaggctgggctcatgaccaatcttctaagcctcctggctctctgggctccagccacccaacttctcaggtccttgtacccagtgggctcctccccaccacacttcccacagcacttggtgctttcacccattagctgctgtccacagcaagagcctgggagctgtgctgtgatagacataccctttgtcttctgaaggccctcttccttcgtaattagtcattttagccattgatgtcatcacttgatgttgacttctcccctactcagacgctgagctgcctgagggcacagcacatacctcttgcttatgagtgtgtcctagcatctttccccatgctggcatacagtaggtgctcaatatgtgcatgttgaattaatgcatgaacacaccaaagcctccctgtgcccgagtttctaagcagatggacttgagtgagaggccaggcaaccagaaccctgggctggtgagggcctctccacctcggtacaagggcaggggtgggatgcacagagaatggccacgccctgcccgtaagccccaggggcaggtccctgtgtgtcctcttggcttctctctcacagggcctcaggcatctctcaggcagctgcctcagtacccccactccatctgccattggaaactcccagactcccagctccatgaaccctagagggcctgggactccactagggagcagagagcgggtggctgctatagcttgccctgaaatggagacccaaatgccaattcccaaggctgggctgcacccaccagccatgggcatgaggatcaaatgtgtgggctacctcctactgcgtgccagaaaggtgaggatgtcaggactgacagtcaggcttgtggcccggagctgtcacccactagctatgtgactgtggggaagttacttaagctctctgtgcctcagtttcctcatctctaaaagaggaataacaagtacccatctcattgggtggttgtgaggattaaatgaacacatgtaaaactttaagcagcactcgatactggataaatattattattatttattaaaagttattaaaatgtatcatgtgaccacttccctgcaaattacttcagttatatatttcatttttatccttacaacaaacttcagaaatattatcatccccaggccaggcgtggtggctcacgcctgtaatcccggctctttgggaggccaaggcaggtggatcacctgaagtcaggagttcaagaccagcctggccaacatggcaaaaccctgtctttactaaaaatacaaaaattagctggaatttggtggtgagtgtctctaatcccagctactagggaggctgaggtagggagatttgcttgaacccgggagacagaggttgtagtgagctgagatcatgccactaccctccagcctgggtgacagagtgagactctgtctcaaaaaaaaaaaaaagaaatattatcatccctgttttatggctcaggaaactgaggcagcctattcaatagaactttctacaatgatggaaatgttctgtgtttctgcagtgcacagtacaatagccaccagccacacgcggatccacagcactcgaaatgtggctgatgtgactgaggaaatggattttgaagtttatttaattttactggatttaaagaaacagtggctgtcttattataccgtgcaacttggggaggtgaaatctctttgtccaaggtcaagcagtgattgagtgtttaagtcaggatttgaaacaaggcagtcttaactgctctgtgggcaccacagctgcaattctctgagccccaggtcccctgttgagttgccatccctgcttgcaatgaactctcaagtggcaccctttttttagcttggggttcccgccacctcacatagtgcctcaacttcttccttgttggtcacattgctttctcaggaccagtttctcctgtgggttcctgggcccctggggatgcgtggtcagggaggcgggaactcgccaggctccgagtttagctgcatgaagctcctggctgaccagctgaaacccgcacctcaccccaaccaccacacgtgccttgggccccatgttggggcctttcagggagacatccaccctcattagcctgtgagcttccatttattttttcaacaaatacctattgtgtacccactccatgccagctgtcttctgggaacagggccccagaagtaagttaggcagagtccctgctctcagagttcagagtgtgctgtggccacaggcacataaataataatagaggtaatgcagtgtggtcagcccttgcacggagataggcaggggctcagtggcagcttaaaactgggaaccgatgactcgactcaaaggggaactgagaaagacttctaagaggaagggatatctgagctgggtcttgaaggatgagtaggagcttgctagctagaaaagaataaggcagaacattcaaagccgagggaatagcatgtgcaaagccttgagaaaggggctcagcatttcaagtttggagtctggagggttccatgtggcacagttagagagcagggagcctcagggagaggtgcaggtggtgagactgagagggttgagaacagggcctttggagtcagactgcttggatttcaattcatcttactccatgtgaccttgtaccaccaggcttccttgagccagtttccccatctataaaaggggccatttccccgtctgtaaaaagagcaatcctcataggcttgttttgaagattaaatgaggcaatgcatggccaaagcttagcaagctgcttgactcttgtaagtcctcagaaagcattagacattgttattgacaatgtgatgtgacatgctattactgttgctgccggggctgttgctattgttatcactgctattgtcactgtagctccagtgcaacaaaggagatgggggcacattaagaagagcttcccatgcctggcaaaggagtgtggattttcttctcttggcaacagggagccctcagaggtttgtaaacggagagcaacatgattagattaatgaagaagctctctctggtcgagggtgttaggaaggggaatgacggggaggtagggaaagatgatgaaacttcatccagggcagagggtggggacagcgatttaggagatgtgcaattcatacctggtgatagattgaagctgggaagggaggaagtgggaggaggcgggaggaggcgggaggaggcggctgactgccaggtgccatttcccacctcggccgcagcagaggaggaggcccgcccactccaccagctaccacccactccatgtgcgcccctgcacccagcccccaacgcagcccttattcaggccgggtctcccaggtgtagactggtccagcccctggacatctatctcacaagactctgccatctgggcacacagtcccctcgcccttcaaccagaggcttccactccaccccctatgtttcctgcggtctctaggggttggatttctggccctcttgcccctgaccccaggggctcctcagcggcatctcccagtgaaggcctggagatgctcaccttccaccgcagcctcgcttcgttgcctttggcgccctctgccggccgcgccgtgctgctgcgtggttctcccgcccgtctgaagcagcacccactcgcttacagggtcacacctttccctgcctgtccggagagaatgtcctcagacctagccaccgtcccccccgcacccccgcacccccgccccgcaaagaccggctggcgcagaaagaacctgggtctctggcgccatctgtgcaaacggctgctcctttcccacatgtcctggcgctgagccctggcttccctggggataggggtggggctgtggtgccgccccatcccacgcctacacccacgcccacagccacctggggccgtgggcttccacggccgctcctgctccttctgttggcgtctggactcttctctctatccctgtggtcgtttctggaggccaggccaccatcatctcttaactgggtggcttcaacacagctcctcactgtcccctcccaacgtgcacacatgtacgtgggcgtgcacgcgcacacacaccatctgttctccacgtgtaatcagaggagcagttgtttttaaaagcaattctgatcatgctccccttcgtagtgtaactcaatgtctcccattgcactgatgaccaagccccaagcccttatctgggtgggcagggctgagcctgtgagccctgctgtgtcccctgctggctttcgcagaggtcacctctagggaagagtttcatcccgcagtctgtaaagtggctccctgtctttctcctctctcccggcctttcccatcctggtgcctagcttgacgctcctctgtctccttgggatcttttcctccctgtccctggagcctgggggccacctgtgttggagcctgcgttctctctaggaggctgcaggctgctggcccttcccccttactggggctgccccacgtgccatcactgcagcatgtaggcaggaacacaaacatggctgtctcctcgcagggactatcaggacccctagaatgctcacgttgagctggattatttcagggggagtcttggttacctgaaggcttccccaagatctgagctacctggtcagaggttcctaagtcagaggtttcaagctatgatcttgaaaccgctttggaggccactgccaggaaaggggacaccctcccaacacacacacccctgcctcaacccaaccaatcctgtttgaatttactggtcatctaagtgagagttctccatataattttctttggagaaagccttttgggattaaaaaatacgttttaaaacctcattcaaaattttgtcccatttcactgatacttgcaaagcactttatagctgacagagtgttttttacctgtatatttttatcttacatattattaacttcatttttactcacaaggagactgaggcccagagaggttaagtggcttgctcaaggtcaagggcaatgcttacagtgtgaacatcatggagctggattcaaacaggccttccacagtcttcctcatggcctcttgcggggaacctggtgtgtcctgaccagggcccggggcccagtgccctgcctggagctgactctgcctgtgtgtctctcccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtagtacgtgcccctccctgccccagagcagcctccctccacctcttgtctttttccaacttccttctttctctcctccctccctccttccttctttctctcctcccttcctccttccttctttctctcctcccttcctccttccttctttcttccctccctccctccttccttctttcttccctccctccctccttccttctttcttccctccctccctccttccttctttcttccctccctccctcctttcttctttcttccctccctccctccttccttctttctctcctcccttccccccttccttctttctttcctctcttccttctttcttttctcccttcctcccttcctttcttccctcccttcctccctttctgcctttcttctgtctcccctcccttccttctttcttcccttcctccctcctttccttctttcttcctccctcccttccttccttctttcttccctcccttccttctttcttccctccctctctccctccctttcttttccctacctgcctccctccctctctccctcccttcctttcttctttcttcccttcctccttccctccttttctgcttttcttccttcctctcttttctctttttttctctctctctgtcactctttctcagtctctcttggtgcttgtcactttctttctccccacatcctctcttcatctctctctctgcttctacctctcaccctctcctcccctcagttcccctttactctccccatctctgtgtgcctgttctgctcttttcttcttctatctctgtctctccttcactcttggtctgtctctgtattttccagtctctttttattttctctcttctcctttcattctccctttccccccaattttttatagtgataaaacacatataacataaaataccatcttacccattttaagtgtgcaggttagtggtattaagtacattcatattgttgtgcagccattaccactctccatcttcagaatgactttcatctcgcaaaactgaaactctgtacccatcaaacagtaattcccattccctgcctacccctggctcctggcgaccaccattctactttctgtctctatgaatttgactactgtaagcactttatagaagtggattcagaaaggccgggcacggtagctcacgcctgtaatctcagcactttgggaggctgaggcaagtggatcacctgaggtcgggagttcgagaccagcctgaccaacatggtgaagtcccatctctactaaaaatacaaaattagccgggcatggtggtgcatgcctgtaatcccagctacttgggaggctgaggcaggagaatcgcttgaacccaggaggcggagtttgcgatgagctgagatcatgccattgcactccagcctgggcaacaagagcaaaactgcacctcaaataaataaataaataaatgaaaagtggattcagctgggtgtggtggctcacgcctgtaatcccagctactcaggtggtggaggcaggagaatcgctcgaacccaggagactgaggttgcagtgagccaagattgtaccactgcaatccaccctgggcgacggagtgagacaccatcttaaaaaaacaagaagtggattcatacagtatttgtctttttttgactggcatatttcacttagcataatgtcctcaaggttcatctatgttgtagtatgtgtcagagtttccttcctttttaaggctgaatgtactccattgtatgtctataccacgtttcacttatgcatccattcattgatggacacttgggttgcctccatgttttagctattgtgaatcatgctgtgacgaacatgagtgtacaaatatctcttgaaatcctgcttccaattcctttggttatacacccagaagtggagttgctggattgtatggtaatgctattttaaattttttaaggacctgctatactgttttccacaacatgttacattcccaccaacagtacacaaggattctagtttctccacatcctcaccaacacttgctattttctgctttttcttttttgttagtagccatactagtagatgtgaggtggtctctcactgtggttttgatttgcatttttctcgtgatgagtgacgttgagcatcttttcatgtgcccgttgtccatctgtatgtcttctttggagaaatgtctattcaagtcctttgtccatgtttgaactgggttgggtttttgtcattgaattttaggatttctctatgtattctggagatgaatcccttatcagatagacgtactattttctcccattctataggatgtctttgaaatcactgccaaatccactatcatggaggttttgttctatgttttctcctaagagttttatagttttaggtctttcatttaggtcatgggtccagtttgaattaaatcttatatatggtattgggtaaggatctaacttcattcttttgcatgcggatatccaattttcctacactatctgttggaaagatggttggtcttttctccattgaatggccttggtaccctgtctaaaatcatttaaccgtgtatgtgagggtttgtttctggactctattctattttattggtctatatgtttgtctttatgccagccccacactgtttgatgctagagttttggagttcgttttgaaatcaggaagtgtgaatccgccagctttgttcttctttttcagggttgtgttggctattcaggttccttgagattccctatgaattttagagtaagctattctagtctgcaaaaaacatcattggagattacaggtggctgacacctgtaatcccagcactttgggaggccaaaatgggtggaccacttgaggtcaggagttcgataccagtctggccaacatagtgagaccctgtctctactaaaaatacaaaaattagctgggcgtggtggtgcacgcctgtaatcccagctactcaggaggctgaggcaggagaactgcttgaacctgggaggcggaggttgcagtgagctgagtttgagccactgcacaccagcctgggtgatggagcaagaccttgtttcaaaacaacaacaacaacaacaacaacaacaacaacaatcattgtgattcttaaaagtaatggcaagaaccacaattacttttgcaccaacctaaataataattggtatcacccagagctgggcactgggcacacagggatgcagaagtcctggggagccaggaagaaagccaggggttttaagtaccagagctgagacagagccagaccagggggctgatcatctgagggcaaggagtcagagagagtggcccagggcaggtaaccttttgcactggtcttggcagagcggcaggagcccatcgttggctcccggggggatggatatgacagtactgctgccccagctcagagagctggataaacttgctctggggtgtacgaaagctcagagaagtcacagtggagggctgttaggccaaaggactggatggtggcctgtgcctatgtctctgatgggaacctgagtatggctaattctgctaggagcatcagatggccacagcctgatcagtgatggtgctaagaggacaaggaaagtggtgccagcctgggtcagtgggtcccaaagctgatcggtattacaatcacctggggcatgggtttaaaacagattcccatgccctaccccaaggactctttcaggagggctggagtgaagcccacccaagatgctgcattttattcccatggtccccaggtaattctgccacatggcatccagggccattcttaggaaccactggcccaaagggtaaattcttccaaggagtcccaggtctccattcttctacctctgtactatcagccttttgagtagggacttggaggaggtggaatataactgaggatgtttctgcatatgggcaaaaaatgaaatagaacatggagaagtaaaaagaactaatatgagagacctggttttgagtctggactctactgtatccaagctgtgtgaccttggacaagtgaccgaacctgtctgagtctttttttttttttaaacttgctctagtcttgctctatcacccaggctggagtgcagtggcgtgatcttggctcactgcaacctctgcctcccagtttcaagcaattctcatgcctcagcctcccgaatagctgggattataggctcccacaccacgccccgctaatttttgtatttttagtagagacagggtttctatgtcggctaggctggtctcgaactcctgacctcaggtgatccgcccgcctcgccctcccaaagtgctgggattacaggcttgagccactgtgcccggtcatgtctgagtctttgtttccccttgcgtgagatggggccaacagtattaacctgagctattataagggttaaataaaaggatgcctgcaaaaggggcttagatcaggtttggctctaagcaagtgcctggtaagtggtgctgctgccattaatgtgatttttgttattgtcaccaggaggacttttatatctgtccctaagtccctgcctgctggttcaacagagtgaaaggcttagggaggtcttctgggatagctgtcctgggactttggtctcttcccacctgggaccctgggatcctgaagctgtcgtgctcttgggctgtgtgtcaggcagatccaagcatcatcttgctggggtacaccttggtggggttttgagtgccgggttgtacagtaggattgcaggcgagaggccagagggcagaggcagctagaccaaccctagccacacctacttggccctcaccctgcctctttctctgcagtggggccgacttgcttgctgtcaactcggatgggaacatgccatatgacctctgcgaggatgaacccaccctggatgtcatcgagacctgcatggcataccagggtaagggagggcagcctgctatgaagtgagcacagcacagagttgcagagagcgtcccttaaatcaatgcaggcgaacagattagctacgcatcggcctgcctcgtgcgctgtgctcagtgaataggatgggtccccattcatatccttatctgtgtgattatcaagagcaggacatgagaggaccctggaaaacatgctgcgcagaagggaggtattgatctcattcgtgtcacccacacacgcaggtggccgcagctggccttgtctcatcttcatcagctgtgacaatttgattcaataaatgttcaccataaagatatattcctatgtgggacaataataaagtcaagaatactggagggtgcctgctctgtgccaggcaccacgctggctgccaggggcccagataaacaagatgtgggctgttctcaactcacaaatgaggttcagaaaggaaacagatgcagcaatgagagacctgcgtgccccagcaccccacagatagacctctgaagcgccacctccttggaaatatgtcacatccccagatcctcagctgcagctgcagtcctgccctggccctgcccttgtgtaccccacagagcctcagtaaccgtgattgaatgtcttgttccttgcacccagatcttcctattcatctcctgcagaggttcttaaccatttttgtgccaatctggtgactctatggaccccttctcagaataatgtttttatttttttgagatggagtcttgctgtgtcccccaggctagagtgcaatggcacaatctcggctcactgcaacctctgcctcccaggttcaagtgattctcctgcttcagcctcccaagtagctgggattataggcatgcaccaccatgcccagctaatttttgtatttttagtagagacaggatttcaccatgttggccaggctggtctcgaactcctgacctcaggtgatctgcctgcctcagcctcccaaatttctgggattacaggcgtgaacccccgcgcccagccagaataatgtttttaaatgcagttataaaagtataggattataaaggaagccaattatattaaagcgtaagtaccaaaacatttttcaatgtgttagatagaaacttcgttaattcattaaacaataagataacaggatatgaaaatagctatagtatctgttggtaacaaagttacaggcactgctaacactactgtgggttttgcttacattctaatggtagggaatactcaatttcgtttaaagcttagtcaaaagaaatgtgtgattttatttcctccttttgtagatctctcctgaattcgatcgaacagtgcttggtctaatggatctttttacggagcatgtcatcctctccttaaatactgtttgtagctgtcagtaacacacttttaagacaggaatgggattcgggctatacaatgtctctctgggcccctacctcaattgactcagctctccacttgaaagtaatacattcattcattcagtccttctgcaactaaaattgattgagcgttgtgccaggtgctacagacacaaccatggttaagatgaaggaaactaacagagaccctggtcagatagggtggtcagcagaggccagcttgggagatgatccagtccaggacctaaagaataagacagaggcagccatctgagcagttggaggtgtgtaggtggatggtaaggactttcaggtagaagaacagcatatgcaaagtgaccaatatgaatccattgcctagtgggtgccaggcaggaatgcccttgctctgtgggccaatgcatggtgtctcatcaggcctgaagacaatgatctatgggcatgtctgcatgcccgcttgactggcatatcctagggaacaagagccatgcctccctcatctgccttcccctgccctctggggtcgtaggcctgagggtgctaaataaatcccctctttcccactgcaggcatcacccaagagaaaatcaacgagatgcgggtggctcctgagcagcagatgattgcggacatccactgcatgatcgcagcgggccaggacctggactggatagatgcccagggtgccacactggtgaggagatgggccagtaccaaaaccaagaccagctaggtccgaagtgggccagcacctggtggggaccaaccctgtacccttggggcctgtctgtgaccttggacctccgcaagaatccttttgggccaggattgcccctggatagggagggtcagcagagcagggctcagcctctttgagaacctggcctctctctgggctgggcttggtggctcacacctgtagtcccagctacctgggaggctgaggtgggaggatcacttgagcctgggagtttgagtttgagttgtgattgcaccaatgcactctagcctgggtgacagaaagactttgtctttaataaacaaacaaacaaaaaagaatccagccactctcaagtggggcttggagttaggagcctgggtcggagacctggctcccacctgttcaccaactgctctgtctccaagatattccttcaccccaggcttcatgtgtccatcttgagctccttatttccctctcctctaatgatgtcctccattaaggactggtgtcaccattcacccactcactcgtgctttcttgctttgcactgtccattcccctgccttagtatcacctctcctaccctagcaccccactgccttgcctcatcagctcccctgatattactgcaacagcctctcctttgggttccctgacttcagagtctgcccaccactcccagtcatccattcatccattggtccatccaaccatccatccatccatccatccatccatccatccgtccgtccgtccgtccatccatccatccatccatccatccatccatccatcattccatccatccatccagccatccagtcaacacacagttatgagcacctcctctgtgcacatactttactagaccctggagacagagaacaatgggaccttcttctctctcaaatccgcctggttaactccactcatccttgcagctcaagtgtcactgacttaggaaaacctccctggccactcctcataggctctcagagcacactgcagcctaatattggggaggtctgcttctgcaacctgtaagtcaaaattcagagcatggctatggcagcctaccccactgactggggggtgggtgccctgtcccaggcttaggttccacgctggtcgtaagcactcagcagtctcgggatctcgagctcactagatagggctcagcagtaccagatatcctcactgcccctcaggcctgacctggcagcccaggtgtgataagtgggcttctcccacctgcttcctgagctctcacatctgttttatgcccatttctattacttgggtgcctgcttggatcacctgctcagcctagcactcaagaatggggtcaggtaggaagtctgactatttctgtctgaagtcaaggccaggctgcactagggcattacccagcctcattgcagctccaatggggctgtcattgggtcctctagacacagggatcttctctacctgggctggggctggcctcagggtggccccacccccatgggctgggcatatactaggtctcaggtcttcccagtaaactggagatcatagtgtcttcctcacagtgttgctgggagcattaaatgagattctgtgtgaaagtgcttagcacagtctgcaaattctcaatagatgttagcaatgaccattatttttactaacaatgccactattccactcataccttttcatttccagccaagtagtgaggtttgtaatgtcggactggccagcaggtgtcattctctacaactgacaagcatcagacatttataaatcagataattatactaattttcacatcatacccttgctttttcaagttggaaaaaaaaaaagcttcaagcaaccttctcccaggatgaggtggcatctgaccatcagggctgtgttcagaaggatcacttcctgaggccatgccttctttgtcccactgactctccagcccaagacctcaggcccccgaggttctctggcttcctcccagctagtcttctgctagccgccttggactctcacttctatctctcatcttggctgggcagttgatgtctttttgccttatttccttctctctccttcattcattctcatggtcatcatttaggactctctaagaatgtgaatcccttactgagtgttcattatgggctaagctatttatgtattttgggggcaaattgaacaatcatgacaactgaggtctgccaggcagtggccatgactgaaggccttgaatgggatcacagtccctcattggatgtattatctattgctgcataacaaactaccccacaatgtagcatcttaaaacaataataaatatttattgtctcacatggtttctttgggtcagagagttaggaacagcttaactgggtggctctggcttggtggctctcatgatattgcaaccaagatgttgcaatattgttgagactactggggctgcagtctcatctgaaggcttgactggtactggaagatccacttccaagtcagttcacacacatggctggcaagttagtgctggctgttggcaggaagcctcagtttctcacctctttaggacctctccttgaggcttcttgaggatcctcacaacatagtggctgccttcttctagaataattgatccaagacaacataaagtagaagcagaaatgccttttatgccctagcctcagaaatcacaaacaggatattcacaatatcctacttgttagaagtgagtcactcagtctggcccacattcaaggtgagaacagtcaggctccatcttttaaaggaagatgtgtcaaagaatttgtagacatatttaaaaatcaccatattgaacctcagagaccccttcttcagggctcaatgcacagtaggggctcagtaaatgctatcgctttaaccacatggatgctaagaccaaccacaggggagaagaattcagctctctacctttccttttaagtccatatttcagacttaataatcctctgcaatgtgactggtatttccatttcattctattccattctactggccccaaggatgctgtgggagttgggtgaaggtgagagctagcctaccgtcaatgtggggctgatcccctgaggaatgctcacttctttcctctcctccagctgcacatagctggagccaatggatacctgcgggcagctgagctcctcctggaccatggagtgcgtgtggatgtgaaggactgggatggctgggagcccctgcatgcagctgccttctggggacaggtagttctcacccacagggctgtgggggaggccggcacagggctaacctgctgacaccaagttttttgggctggcagttgttttcaaagaacataagactttaaggcttaaggtgttgaatatagctcatatgtgggatatgaaaaggcctagggagtttgcaaaaaacattggacaaagcaagttgtgttttttttttttttttttttttttttttgagatggagtcttgatctgtcacccaggctggagtgcagtggtgcaatctcatctcactgcaacctccatctcctgggttcaaacaattctcctgcctcagcctcctgagtagctgggattacaggcatgtgccaccatgcccagctaattttttgtatttttagtagagacagggtttcaccatgttggtcaggctggtctcaaactcctgatctcaggtgatctgcctgccttggcctcccaaagtgctgggatgccaccatgcctggctgacaagttgtgttctaataggatggtaatcaaatttgccaaataagaaaattaccagcatttttgcttctagcagtttctccatttgtttccagatacaaaactctgattgtcacttacacctagtccctccttagatacctgccagctctagagttacagccaactctttcttctccttcttcttggtgtggcccaggcatgtggaggaggtgctaagctcattgcatctgtctggattccccccatggctctagtttgcaggccttccctggaaatcaactttgtcccaccattctttgggtcacatcctaagaggccttgggcactctctccacctcctaggctttctgagctctgggcagggggacacatgagcttcttcctgtgtttcagatgcagatggcagagctattggtgtcccatggagctagtctcagtgcaaggacatccatggatgagatgccaataggtaagtccagcacaatagctggtgtgcacaaataggcagttatcaatgttttgatgggtagagggagaaatagataaatatatggttgtatagattgatggattggtgtctagatagatagatggattaattaatggatggtagatgaatggacggatggacagattaatggatagatggataaatggatgaatggatggttgaggtggtagatgggtagatattatgaggtctggttgaatggatgggtgggtgggtggatggatggatggatggatggatggatggatggatagacagaaaaataagtggatgagtgggtaaaggatgaatctatgaatacatggctcagtcagcaataggtagatagatggatgaaggggttaggtagaatagatgggagtatgtagctttattagcatctttgcataatttattgcttgggctatgtggggtacctgcttggggactcttcttggaaactatcaaagagcaacatgaatccctcggtcatagctgggaagcttaggaattgtgactgtgcccagaacctgggtttcccattcttataatcctcttataaacacactcactcaactttggctggcattgttttcttgcctccctgcatgccctgaaagatgcttggagttttcagtgggttggggtggcagctcctctggtctggagcaccctcttgcgccacaggtcctggccccgtcccccacaacagactcctctgccccttcagacctgtgcgaggaggaagagttcaaggtcctgctgctggagctaaaacacaagcatgatgtgatcatgaagtcacagctgaggcacaagtcatccttgagccggaggacctccagcgcaggcagccgtgggtgagtccggggcagggcagccaggagtccctgtgtgtgctcctgcctgtggtgcctgggtgcagcctctaggacccactttgtcctctcaggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctgtgagtggcctcacgccctgccctagtgtcagccactgcaatgggaggagaacagggcccagcctggccttgcctcttcaactgagagccttcagagggaagtagccaggcactgcccttaaactagcatatccagtctgatgatgatggctactgtagttaaaccagcagattcagtctgatggtggtggctgctgtagttaaggaggtgatcggggagtgtgttagaggctgagctgggtgctttggcacacaggtaggtctcctaattgacagggggtgagtgtccgctatgcgcctagctgtgctccagcacacctagcagtggacttccaaggagagagcttcagtagggcagtcacccaggagctgagggtgctacaacttctttttcaggaaatataacaagatattgagaattgtgtttatcagaacatgttttttgaaaaatggagtaggatcctagtaggacctctgagaagcctgctcctgtagcagccaatggtcctttaagctttaagctgctttcatttctgatggctgctttaagaaattatcacaaactggatggcttaacatggtggaaatttattctctctcagttctgaaggccagaagtctaaaatccaggtaacaccagcattggttccctctgggggctctcaaggggattctgttccacgcctctgcgagcttctggtggctcaggcgttctttggctcttgctagcaatgattctagtctctgcttctatctccacatgacctttttcttcgtgtgtgtgtgtctgttttctttttttatttttattttattggttttttttgagacagggtcttgctctgtcactcaggctggagtgcagtggcatgattatagatcactgaagactccaactcatgggcttaagcgatcctcccacctcagcctcccaagtagctgggactataggcgggggccatcacgactggctaattttcaaatttcttgtagagatgaggtcttgctgtgttgcccaggctggcctcaaacttagcctcaagcaatcctcccaccttggcttcccaaagtactgagattacaggttcgagccactgtacctagcctgttttttcctcttatgaggacaccagtcattggattggagcccatgccaatccagtatgacctaatcttaatttaatttattacacctgcaaatacctatttctagataaagtcacattcagagattccaggtagacatgaatttttgagggacactacttaacccagaaccaacacactcactcagcatggctgctttcttgctgagtggagtgaacaagtttggggctggagtggaattgctgaggatgagggagaagttaactgtaccagaagtggtctgccattttcgttcttccactacaccacgaacagatgaaaacatgcctagagagtttagccttggtgggatgaaattgattagctaccgagcatgcccacgtgtctcagagggaccctgcttcccagcacgaacagtggggtcacctactgcctgtctcaccaggaggtgtgaaggtgcctgcccaaggggaggccacatcaaagccaccagctggtgatggagagggcacgtagggaagatttgttctgcctggccccttagtctgaggattggtgagaaaagagatgtagatcagtatcaaatcacatttcagatgtctcccagctgtgctttatttatttttcctttgtgattgtggtgtaacttaagtatggtaaagcagacaaatctttttttatttttttatttttttatgatatggagcctcgctctgttacccaggctggagtgcagtggtgtgatttcagctcactgcaacctgtgctcccgggttcaagcgattctcttgcctcagcctcctgagtagttgggattactagtgcccgccacgacgcctggtggatttttgtatttttagtagagatggggtttcaccatgttggccaggctggtgttgaagttctgacctcaagcaatccttacccacttggacctcccaaagtgctgggcttacaggtgtgagccaccatgcctggccaagtagacaaatcttaaatgagattttcaacaaccttttacaaatgtacacactcagatgaattcatagagcattttcatcatccatgttctctctccgtcctttcccccactccaaatgtagtcactatttaactttgagttctaaagattaattttgtatatgcatatgaatgaccctgcagtttctttcgtgtctggctttttttacatctgtgagagtcacccacgttgtggcatatagcagtagtttttttttgttttttttttttgagacaggagttcactctgttgcctgggctggagtgcagtggtgtgatcctagctcactgcagccttgacctcttgggatcaagcgatcctcccacctcagcctcttgggtagctgggactataggcatgcaccaccatgcctggctaattaaaaaaaatttttggctgggtgccgtggctcatgcctgtaatcccagcactttgggaggccgaggtgggtggatcacaaggtcaagagatcgagaccatcctagccacatggtgaaaccccatctctactaaaaatacaaaaattagctgggcatggtggcacgcgtctgtagtcccagctactcaggaggctgaggcaggaaaatcacttgaacccgggaggtggaggttgcagtaagccaagatcgagccactgcactccagcctggggacagagcgagactccgtctcaaaacaaaacaaaacaaaacaaaacaaaattttttagagatggaatcttgctatgttgcccaggctggtctcaaactcctgggctcaaatgatcctcttgcctcagtctcccaaagtgctgggattataggcacgagccactgtacctggcctcattcttgttttttttttctttttctttttttttttttgagatggagtcttgctctgtcccccaggctggagtgcattggcgcgatctcggctcactgcaacctccatctcccgggttcatgccgttctcctgcctcagcctccctagtagctgggactataggtgcccaccatcacgcccagctaattttttgtattttcagtagagacggggtttcaccgtgttagccaggatggtctcgatctcctgacctcgtgatccacccgcctcagtctcccaaagtgctgggattacaggcgtgagccaccacgcctggccgcctcattcttttttattgctttctagaattcgattgtttgaatattaaaatttacatatccatgctcctttttttttttttttaaattgagacagagtctcgctttgtcacccaagctagagtgcagtggcgtgctcttggctcactacaacctctgcctcccaggatcaagcgattctcctgcctcagcctcctgagtagctgggattacaggtgcgtgccaccacgcccggctaatttttctatttttagtagagatggggtttcgccatattggccaggctggtcttgaattcctgacctcaaacgatccaccctcctcggcctcccaaagtgttggtattacaggggtcagccactgctcctggcctccattctccttttggtggacatttgggtttcttgtttctggctcctgtgaataaagctcctataaacatttttgtacatgtcttttggtggacataagcactattttgtgttgggaaaacacccaggaaagcagctggagtcacgggtaggcatatgtttagctttagtggatactaccaagcagttttccaaggtgccttgtacctgtctgctttcccatggcagagtgtttcttgccaacccttggtatagtcagtcttttttttttttttttttttgatacagagttccgctcttgttgcctagcctggagtgcaatggcgccatctcggctcactgcaatctccgcctcccgggttcaagtgattctcctgtctcagcctcctgagtagctgagattacaggcacctgccaccatgcccagctaatttttgtgttttagtagagatggggtttcaccatgttaaggtgggaattctcaaagcatggtccctgtaccagcaacatcagcatcacctgggaacttgttagaaatgcagactttggctgggcacagtggatcacaaatcctgtaatcccaaaactgagggaggctgaggtgggaggatcttctgagcctaggagttactggacaacatggcaagaccgtatctctaccccccaccaaaaaaaaaaaaaaaaaaaacaattaggtgggtgtgatggtgtgtacctgtagtcttaggtcttgtgaggctgaggcaggaggattgcttgagtcgaggaattcaatgctgcagtgagctatgatagcaccactgaactccagcctgggtgacagagtgaggcgtggtctctaaaaaaaaaataaaaataaataaatgtagattctcaggacccactccagatgtggcgatactgctgcacacaagaatttcagaaccacttatttgaggaataatttgttcagcctgacccccaaatcacatttcttccaaggctgtgccctgttagccttcagggatgactttggttcactgttttttgtttttgtttttttcctctgagacaaggtctcactctgttgcccaggctagactggagtgcagtggcgcaaacttcgttcactatagcctctgcctcccagattcaagcaattctcccacctcagcctcctgattagctgggactacaggcacccgccaccatgcccagctaatttttgtgttttttggtagagatggggtttccccatgttggccaggctggtctcgaactcctgaccttaagtgatccacctgccttcgcttcccagagtgctgggattacagacatgagccactgtgccccttgttttttaatctgatgtttaagtagcagtacagacaaactaaatcagaatctcaggagttgggacctcagcattgtatatgtttgtcattggtgtttttttttaattttttttagatggaatcttgctctgttgccaggctggagtgcagtggctcaatcttggctcactgcaacctccgcctcccaggttcaagtgattttcctgccttagcctcctgagtagctggaactacaggcgcacgccaccatgcccagctaatttttgtatttttagtagagacggggtttcaccatgctggccaggatggtctcaatcccttgaccttgtgatccacccgcctcgacctcccaaagtgctgggattacgggcgtgagccaccatgcctggccatgtcgttgttttttaaagctaaagagagactgtttttgaagtgattgcagcagtaagtagaatgcatcgaccacagaattggcaagatcttggaggtcaaggagaaaggagttcgtttcctagggaggaagacagaggctgcaaggactgagggttgggggtgggatgagcaggtggtgtaattggacagttgaccaggaatgtgtgtctggtggtcagcccatttccagaacggtcttcaggagagtttttctgcattgcagtgcttgtttaccctcagggtgagtcaaagtccaggatcctgtggggaggggagcagcttaactaaaatttggttaaatcatttaccgctgggcgcagtggctcacgcctgtaatcccagcactttgagaggcccaggcaggcggatcatctgaggtcaggagtttgagaccagcctggccaacatggcgaaaccctgtctctactaaaaatagccaggcgtggtggcaggtgcctgtaatgccagctacttgggaggctgaggcaggagaatcacttgaacctgggaggcagaggttggagtgagccaagattgcaccactgcactccagcctgggcaacagagtgagactctatctcaaaaaaaaaaaaaaatcatttagcaagcatttaatttcggttgataaattgacagtttaatcatttcagaggaaaagaatgagaatttgggggactgtgtttgggttgtcctaggaaaaggaggggtcgtctgagcgttctggaaatcctatggggaagggtgattctgtgcagtcagccattccccagaacacaaaatgtgggggttttgtttaaccttcctgttgtccagtatctcagttcaacattgccaagatgatggtgcctaccacaaagggtgttctagggtcaattgtgttcttatttgtatagaactcagcccataatttgtacctcattaagcattaggcagataagtacatttagaagttccctgcatcatgagaaaacctctttcgtctaacccacatccttcaggctggagttaattcctcttccttcaatgctctgatttctgacactggagatggatataggtgggttttgttttcttttgttgagacagggtctcattctgacagggtcactcaggttagactgcaatggtacaaacatggctcactgcagcctcaccctcctgggctcaagtgatcctcctgcccagcctcccatgtagctgagccacaggcacgcaccaccatgcccagctaatttttaaatatttgggtagtgatgaggtctcactatgttgcccaggctggtctccaactcttaggctgaagccatcctcccacctcagcctaccaaagtgctgggattacaggcatgagccactgcacccagcagggatttttttctttttaaactaatagattttttttttccgagcagttttagaactctagaaaaatgagtggaaagtacagatatttcccatatacacccccctccaccctggtttcccctgttattaacaactagcattagtgtggtacatatgttatcactgatgagccaatattgatacattattatgaactaaagcccatagtttacatcgggtttgctctttgtgtcgtaactcctgtgggttttgacaaatgcataatgtcatgtgtccgtcatgatagtgtcacacagaatgctctcgccacttggtttaggtggttatattagacagttgagattgtgaacaactggtgaaagagaccagggctgtcccactaaacagccctggtattctacttacgcttcctccccaaactctagcaatcactgatcttctactgttttcataagtcttgcttttccaaaatgttatatacgtggaattatataatatgtgatgctttcagattggtgttctatatggtttttttttgagacggagtctcactttattgcccaggctggagtgcagttgtgcaatcttggctcactgcaacctctgcctcctggttcaaacaattatcctgcctcagcctcctgagtagctaggattagaggcctgcgtcactgcgcctgtctaatttttgtgtttttcttttagtagacacaaggtttcaccatgttggccaggccggtctcgaactcctgacctcaagtgatccatccaccatagcctcccaaagtgctgggattataagcgtgagccaccacgctcggcctgtacatgtttttttttaactgtctagatgatgccaatgtgcatccaagatgggatcagtgtctcagatctttgccactctaagcatcagcaggaaattcttagaagtgccaaattgcaggccccaacccagacctattgaatcagaatatggattttaacaatatccctaggcaactcacatacacatcaaagtttgagaagcactgactaggaccaccaagaaacggtctctccatgacatggcatcagtctgcctgcatagttcagaaggagccattaaaaaaaaaaaaaaggttggactcggtggctcatgcctgtaatcccagtgctttgggaggctgaggtgggagaatcatttgagaccaggagttcaagaccagcctgtgcaacatagtgaggccctgactctaaaaggagaaagcgaagaaatacacactcataaatggaaacttactatggaaagtgttctttgccttatcacatattaccatatatatatataacatatatatgttatatatgttatatatgtatgttatatataaatacatatatatgttatatgtacatatatgttatatatgtacgttttatatatatttatatatgtatgttatatataaatatatgttagaaaactagattataaactagattatatatatatatcttggacatctttccatgccagcttgtggagaattccttcattctttttgccagctacagagcatgccaatagaagtactggccacagtgtcctgcttgcccaatgatgactttcaggctttgcactaatgagagagaaaatctgtgaaatgggcttgctggtgcaaagtatacaatcttttctaaaaatttttatcattattattgtttttattttttactgaagagctggggagagaagaaaggaaaaaaagaaaaaaatttcagtgaaggatgatgcaaaactgtccatcaaagagactgtagcaatttacattctcacttatttccccatacccctgccaacactgagtaataacacactttaaacgtatttgtcagtgtgatatccaaaagtgatattttgttgttttaatttttatagtattaacgattagtggggatgaatattattccaatgccatgtatatctatatattttgctgtgggctacatattagtatcccctgcctactatttttattgggtagataggcttttaaaaattgacttttggctgggtgcggtggctcatgcctgcaatctcagcactttgggaagctgaggagtgtggatcacttgaggccaggagttcaagatcagcctggccagcatggtgaaaccccatctctacaaaaatacaaaaatttgctgggtgtggtggtacgtgcctgtaatcccagctactcgggaggctgaggcaggagaattgcttgaacccgggaggcagaggttgcggtgagcagagattgcgccactgcactccagcctgagagacagagcaagactccgtctcaaaaaaaaaaaaaaaaggacttttaagagctctttatacttttagaaaattagtctcttttctgtaatatatgttgaaaatattttcctagtttcttcatgtgtcttttgaccttgttccctgttcatggtgatttttgctgtgctttaaatgttgttgcatgtatctattttttagtttatagtttttaggaagcagctacttttcaaactcttgttatccaaggattattaggtgtacaggatccctgggtaagaatctttgtgagatatgcttcatatacagaggaaggattacaagtgactgaaaaacccaactcaaatggacttacacacaaggaatttattggcttgtgcaactgaaaagtctgagcctggaaggatcctggacttcaaatgggtcatcaggatgcagtctctcttagcctttcttcatgccaactttacttgcaagcagacccttcaacatagtatctccccagccctcagcttacgtcattcttactacccacagttcctacagaaacttctctttcccagttgttctagcaaaagtcccagggttgcttcactgaagcaatttcagttaagaactcatccctgggccaatccctgtagtgaaatatgttgactagctaggccttgggtcatgatccaggccctggagcaaggccaggggtcggtcaactgtacggaaattcatagattgggggttccccaaaggaaaaccctggccccgatacccagggagagaaaacagatagaggaaaagtccaaacaataatgccctcagcagagagacaggtggatagtaggttcagatcttccagccagctggtaatgttgtccttctcactcgcagaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataacacctgctagtgtgagtgattattgctgtgagctcacttgaacagtgctgacttgaattcacaaagaggaggttcctggaatagagggtgggtgagagctcctagtctcttcccccttaccccacccctttcccacagagggctttcccatgagacccctgaaatagagggagctctgggggctcagacctggagcagatgtctccccagactaggagatggtgaaaactgatgaattcaagaaaaggtgggtggttgggaatgaccttcattctgtcaaataatctctttgaaattaacatgaggccgtatagtagcatatatttattccatacattttcaaagtttttcctgatatttatttatttatttttatttttttaagatggagcctcactctttcacccagtctggagtgcagtggcgtgatctcagctcactgcaacctctgcctcccgggttccagcaattctcctgcctcagcttcccaagtagctgagattacaggcgctcgccgtgatgtccagctaattttttgtatttttagtggagatagagtttcaccatgttggccaggctggtctccaactcctgacctcaagtgatcctcccgccttgagctcccgaagtgctgggattataggcgtgaaccaccacgccccgcctctcatgacatttatatgtaacaagggtgcccctctcctctgtcccattcttggagtgaactgacatgtcctgtcctcttccccctgccccattccactctttcccctcgtgtgcttattgtggggaagtacgatactataaagtacttcaccttatgacagcaatacagcagctaaggccccggccattctcattttttacctcgagcattaaaggcatagagaagctatgtggttgcacagcctcagaccacagtccttggtccttgtcccacacagaactttgttggtgtttttcttgaaagaggatgaaaagggtgtcggatcacaaggtcaggagttcgagaccagcctggccaacgtgatgaaaccccatctctactaaagatgcagaaaattggccaggtgtggtggcatgagcctgtaatcccagctactcaggaggctgaggcaggataatcgtttgaaccctggaggcggaggttgcagtgagccgagatcacgccattgcactccagcctgggtgacagggcaagactccgtctcaaaaaaaaaaaaaaaaaaaaaaaaaagaaggtgctctcttgcagcctcccggaccctggataccagcgcagggacacatggaagtccccacacttattcttgagaaacttcacaaagggatggggatggggagaggagaggtagagagggagaggcgtctcaacagcggcaggcattcatccatttaaaaaggttattggttgctaaataataatggtaacatctcacatttatgacccacttttcatttacataaaaaagatgacgactgaaaattgactgttggatttagctctgtggaactcatgatgaacctgacaagaggttttggtaaagcagtgggggttttagcctgattgaagagggctggaagggaactggagacagcaagtatagacaactggtttgagggtttcttttcttttcttttctttctttctttttctgagacagggtcttactctgtcacccaggctggggtgcagtggtgtgatcatagttcactacagctgcaaactcctgggctcaagtgatctcttgcctcagccttcccactggctgggaccatcatgagcactgccatgcactaaaagttaggcgcaccaccatgcccagctaacttttgtatttttttgtaaagacagggtctcactatgctgcccaggctggtctcaaactcctgggctcaagtgatcctcttcccttggcctcccacagtgctgggattacaggtgtaagtcaccatggccagccacatctgagattctatgctgcaaaaataagaagtgagatggggagctttagaggaatgtagggtcaagagagggttgttttaagatgaaaaatatttcagcatgcttgtaggctgatagaaatgaatcggtaaagagggaagctgatgttccaggagaaagaagaagattgctggagcgatgctggtgagtagtagaggggctggaaatgcccaggcagaggggttggggttggatgggcacaggcacagttcatcaatgcccagtatacgggcagagatgcagacaggaaggtagactagatggccgcacgtggacgttcccttcttactgtttctgtgttcttgctgacatggaagacaagctgtcagagaggaaaaggtagagagaatgagggaaatgcggcctaccaggcagtttttttgtttgtttgcttttgttttgttttgttttgtttttagatggagtttcgatcttgtcgcccaggctggagtgcagtggtgctatctcgactcactgcaacatccgcctcccgcgttcaagtgattctcctgcctcagcctcccgagtatctgggattacaggcgtacaccaagacacctggctaatttttgtatttttagtagagacggggtttcaccgtgttggtcaggctagtctcaaacgcctgaccttaggtgatccgccctcctcggcctcctaaagtgctgggattacaggcgtgagccaccgcgcccggcctcctagcaggcagtcttacggattatgaatttaaaacatgaccagtcagtaagcatggttacgctctttttgttttttcttcagccctgtagggctgccggggtgcaggtggaaagtagggtataaccacggttggttggggttttacaaggcaaaaatcgatgaaatgagagaagactacccgagggtgtaatcaaaggagcagtcctaatacgatgagccggtattctttgaatgaatgaatacatggttaaaggcaggtgataaaggcgatatggttggccatgccaaagcactgagagcctaggagcagcgtggccagagtctccgggagtcggcacctgcctctcctcgttgtctaggcctgactgtccctggccttgcacggccgcgcagcggggcgaccggcagggggcgcgctgggatggccaggagctcggctctccccgctctgtccctgctctgcggcccgcctcgcccctgcaagtttaaattcctcttagcaagcccagcatcgcagccaataacgcatcagggggcggagccgtagaggcttgcgccccgcctcgctccgctattggaaggaaagcagccaatgggagagccgaggcggggaggtgcggccaatggcgcgggcctgtttgattcaaaggttgcctataaagcgggactgcacgccggtttttgtccgagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgagcggccctccagggccctgggtcgcacgggagacccccttcaagaatgggaaattgaggcctgctgggagtacgggccggggccactacctcctctgcgccctaccggaagcgcgcgcgggctaggtggtcccagggtctccgactcacaccccactctgcgtgtctcccccggatcccccgggccgctcctcgtggcaggggatagtgggaaagcctcggttcccaaggatgcgaattgtgcccgggttccatctcctaacgttcatatccctgaaggagggaccagaagtactctgagttccaaatttcagttaaaatcaaacttggaaaattgcctatttccctgtctgtcagccaacgctagatcccactttcaggagcttcttaggagactcattaccaaagaacttacgcagggaaagttccagaaagatggtctccagagacaactacggggcattaggaagcaattattattgctaattactttcatgcatcttttgctgtaaaaagcagataaacacgagagtggcaaagtgagagccctgccgctttttctttcttgtcttttttttttttttttttttttgagacagattctcttttgcccaggctggagtgaagtggtgggatctcagttcactgcaacctccgtcccccgggttcaagtgactctcctgcctcagcctcccaagtagctgggattaccggtgcccgccaccacgcccggctaatttttgtatttttagtagagacggggtttctccatgttggccaagctggtctcgaactcctgacctcaggtgatccacccgcctcggcctcccaaagtgctaggattacaggcgtgagccaccgcacccggccccctgccgctttttctactgccagagactggaggggaaactggggcaaggggtttgttttccataggctgggtctgtgccagattgcagtggtctcctaaaatgcagatacatttgcattagatcggcttctgtattcatagtgggttttggtcctactgtctgactcttagtatggcatggtcatgggtgcaatggaggtcttgtctgcttgccagcctcgataaagctgcagcagggtgctggggatcaaggaggaagaaggcagcctgcaggtgggtgtggcacatagagtgtcgtggcagacaccttggtctggagccatggtcaggttgcttgctgactggcagtgcccagctccctggctatctgcctgtgccagggacatggcagataaagccccagccatgttaagacttgttagggctggtacctgagtgtgtctgagtgtgggtgaagataccagtgcattgtcaggttgacatgtccaagccccgactctcaccaatgttcttaatgttctttccctgactggtggggtttcagtggtagtggatacagtgacctagtgccttgcctttgagggagtggttgtgggctgcagctaggctcttaccagccctgaggtgctttgggtggactgagggttttttgatgcagcagacattttccttgcgggttcagtgaaaagattaaaaagatggaaaaggcagacttgtgtaggtatgcatccccaaagctcatgtccagtagaacttgagcacttggaacctgaaaaatgtaaagaactggtctgtatagtgagagctgtggattgttctagtcttttgcccagccccaaattttagtgatagcaaaagggcactggaactagaggccagagggaaactattaaactcacgtgctggcgtgaggaggggatggagccaggagctcagactctccctcatctcacgggcattttgtaatactgacatttccagatagaacctgctgccctagtctagctacccacagttccctccgagatgctgtatttggaacctgggcagttttaactgagaaaggtggtacattacctttaaatccaatgagtattggctgggcacagtggctcaagcctgtaatcccagcactttgggaggctgaggcaggcagatcacgaggtcaggagttcgagaccagcctggccaacatcgtgaaaccccgtctctactaaaaatacaaaaattagctggacgtggtggtgcgtgcctgtaatcccagctacttgggaggctgaggcaggagaattgcttgaacctgggaggtggaggttgtagtgagctgagatcacaccactggactccagctctgggcgacagagcaagactccctctcggaaaaaaaaaaaaaaaaaaatccaatgagtattttcagtgtgtccgatagatgccaaattatttgcttactcattgcctgctgtgtatcagacactaccatggctggggccacaggggaaggcatcatccttgccaacacttgagagtggacagtgtgctgatgggaaacagtgaggagtttgctgcaggtactgcggaaagggctaaagaaagaaagtctccggagtggcagtgacctcagagctgggtggggcttgccagacctagggtatgggggctggcccacaagtgtttaaggacctggaatgtttgggggcagccaaattccccacagcgggttagtggtaggagaggaagctggggtaagggatgctgaaatgagttgggtttgagacagtgctgaatttgaggtcccaaagacaatctcttttgtttaaaaaaaaaaaaaaaagccaggccatggtatcatgtgcctgtagtcccagctactcaggaggctgaggcaggaggatcatttgagcccaggagtttgaggctgtagtacactatgactacgctgtgaatggctactgcactccagcctgggcaacacggggagaccctgtctctttaaaaaaaaaaaaaaaaaaagtaatgctttctgtttgccaggcactgttctaggtgatcccaaggaaggtgcgattatcatcttcattttacagctgatagaactgaggcatagagaagttaagtggccccgaagtcatgcagctagagaatgaaggagcctgtactcaaattgaggcacagaatgtctgaaccactgttaaccaccacactccctgtggagggttcaggagcctgtgctcaggtggggagaggtgacagcagatctggtggctagctaagagctactactatttatgggcatgcattgtggacaagggagtggctgtgtcaccttgaccacatcctttgaaatctagtacctgtgacagcgaggaccatgaaggtgtaggtctcaggctgctttcaggatgaaatgagaagctgttctgcatccgtgttctgatagcaaaggtacctaatggtgatatgattgagcactttgaatgggtcagtttctgtgctaaacccttgacctgaattacctcatttaaccctcccaacactgggaggaggctacaattaagaaaagaccaggcacagagaagttaagtaacttgcctgagatcacacagttagcatgggacagagctgggctcaagcccaagtctgtctagttccagctctgaagctcaagtgttttttttttgttgtttgttattattttttttaagacagagtcttgctctgtcacccacgctggagtgcagtggcatgatcttagctcactgcaacctccacctcctggattcaagtgactctcctgactcagcctcccgagtagctgggattacaggagcacaccaccatgcccagctaattttttctttttttttttggagacagagttgctcttttggcccaggctggagtgcagtggcacagtctcagctctcagtaacctctgcctcccaggttcaagcgattctcctacctcagcctcccaagtagctgggattacaggcaccctccactaatttttgtatttttagtagagatggggtttcgccatgttggccaggctggtcttgatctcctgacctcgcgatctgcctgcctcagcctcccaaaatgctgggattacaggcgtgagccactgcgcccggccaatttttgtgtttttagtagagatgggtttcgccatgttgcccaggctggtgttgaactcctgggctcaagtgattcacctgccttggcctcccaaagtgctgggattacaggcgtgagccgctgtgcccggccactgaagcccacactcctaatccctgctgcatacagcctccctgccatgaggaaggattggagctttggtagttttcaacaggctgaaggtttgtaacagttgaagattgggactttttaatttccatgttgcgtattctataaacaggaaaatgacaatgactagacctgtccttttcaggaagaaaacgaggtggtcagtttttagagtaggaggcattaaggctggcagagaacctcctcaacccatcaagtggggaaggtggttcatgatgccaggagaacataggtctctgagtttaggttttgtaaactagagtgtgttttcctctccctgggaaagatagagccagatagatgtttctggtacctggagcagagggatctgtgagaatcttttggtgggtgaatgaaggaactttgaatgccacatgaagggtcccacttaaccccagaggttggggccaggctgcagtagagcacggtcgaacctcagtgttcgctccatgcagctttatctgccttcactgaggtggtctgaggaccaccctgcatcttcaggaatgtctctggaaggagccaggatacgaggctccttgaccagagtataggcacaggaagccagggttacttggtaaatggtagggcctaatcctggctttgcagcctgaagcgctggttctgggataggttttatccagcagctctctgaccacacagaatcactcagtgtgtctgatacataaaagatgctcagtaaatactgtaggggcctattatgtgcacctttgctcattcagctacatgctttgaggagaaataaagggcagggggaagggagcggtagataggaagaaaagtagttcaggtgattctgtctgcctttccactcagcaagtatttgtccctgggtggctgtgcctggggtttgtgaatctgccagccccttccttgactcttgtttctatatacctttcaaagtgtgggcattctgccacactgaatgaggtacagtgtttaaaaacaaatggtttggccatgcgcggtggctcatgcctgtaatcccagtgttttgggaggtcaaggctggaggattccttgaggccaggagtttgagaccagcctgggcaacatagcgagatcccatctctacaaaaagttaaaaaattagccgggtgtggtggcatgtgcctgtagttccagctactcagcaggctgaggcaggaggattacttgagcccaggagttggaggctgtagtaagctatgatcatgccagtgcactccagcttgggtgacagggcaagaccctgtttctaaaaaataaataaaaacacaattacgtatagcatggcttgaatacaagctggctgcttaccaggtgctcaggcgagcttcaccaaaattggaggaaatactgttttgaaccttttgagaacccatatgtttgtttcctaagcaagtttttggataatcttgaattatacaggatattttccctacatacttgctgtagatccacccctccaccactgtatctgttgatgacgcattcagctttttgcctctgttgctgtgtgaactgggatttggctgggctgtggccgcctgcctggaagggctacatagcctcattttggcaatgtgcttatgaattggctgtccggctattcctggtttgttgaatgagagttcagaggcaaagctggtaccaccacgaggttccaattcctcagagtcacgtttcttaccagtgcctattctcttttgttccaaagaggccacttttgctatgacctcaccctcgggcatcctcttgataacctgagcgttagtagtggggatcattgcgttcccagagagccctgccaggaggagtagcagcttaggaatctgttgggggcccctggcatttacttggatgtatctgaatgaaggctttcctgttcttgcacaactttcctctgcattacagtagagcctgtgtggtgtgatcagtttctgttccaaatgctcatgtcagccccaagcagggcttctcaccctcagcactgttgaccttttgggttggataattctttgtcctgaggggctgtcttgtacattgtaggacgttgagtagcatccatggcccccattcactcgatgccaatagcatccctcacaccaggtagtcatgatattcagtgtctccagagtgggaaatagtgagttactgatgaatgggcacagagtttctgtttggggctatgaaaaagttttagaaacagatggtagtgatggttgtgaatgtaattattgccactgaattgtacacttaaaaattattaagatggcaaacttatctattttaccacaataaaaaaatgtctccagacattgctaaatgccctgtgggggcaaaatcgccctccagttgtgaaccactggcctagaagttctcactagtgcatcattatgggacattacccactggactgaagtgttgctactatttatcccttccttttgatttcatgtgtcaggttaaggattttagaatttagccatttctctttaaaaatattgtggtaaaaaatacgtagcaaaatttaccattttaaccatttgtaagtgtacagttcagtggcattaaatacattcacactgttgtgcagctgtcactagccgaatctccagagctgtttcagcttcccaaagtgaacctctgtacccattaaacactagctcttcataccctcctttcctggccccggcaaccaccattctactttctgtctgccatttctttctttctttttttttttttgagagtctcgctctgtcgccaggctggagtgcagtggcaccatctcagctcactgcaacttctgcctcccgggttcaagcgattcccctgcctcagcctcccaagtagctgggactacaggtgcccgctaccacgcccggctaatttttttgtattttagtagaaacagggtttcaccatgtcggccagcatggtctcaagctcctgacgtcgtgatctgccctcctcggcctcccaaagtgctgagattacaggcgtgagctaccatgcctggcctctgtctgccatttctttattcttttcccttagcgtctagcagacagtaatgaagctgcagaattcttctctgacttctttatggatagaaggtatgttacttcaggaaaaaagcaagcaaaacccaaaaatgtagtggatatattggcttaaaaaaatcttgaacccggtctctactaaaaatacaaaattagctggttgtggtggtacatgcctgtaatcctggctacttgggaggccgaggcaggagaatagcttgaacctgggaggtggaggttgtgatgagccaagatcgtgccattgcactccggcctgggcaacaagagtgaaactccgtctcaaaaaaaaaaaaaaaaaaaaattcttgatgcaaatgatataacctctggaagggaatttggcaatatctagcaaaatttcagttatatttacccattgatctaccacttccacttctctgtatcttgatatattggcaaaaatatgaatagttgtagacaataggccatgcgttgcaacactaattataatagcaaaacacaggaaagagttcaggtgttcgtcagtagaggatgagttcatcattgtgaatgaaccgattcgtctctgcagtggaacatcctgtagctctaagaaggaatgaggactagctctgatatgcggtatctagaatggtactgaccagtgtagtagccatatgaggctattaaaatttatatggattaaaattaaataaagattcagttctgtcatcttggaaggttctattgggccacgctagtctagaacaatgtgtagtattccatgctaccttttacctatagggggatataagcacatatacatagttatatacataatacacatgtttatataaaacaaatatgtttatatacacctgtgtatacttgtttatattgaaaaaatggaagaatatacaaaaaactattggaaatattatctcaatggggaggagggacaaggatggaaactaagtatctttgaaagtaccttgttttgtaaattggattttggaactaggcaaatgttttacatacttataaaataaaaacaattcaaaatgataagccctcctccccctaccccctaacttcttggtgcttttccctcccctttgaaaagcccacctgcttgtgtacttcatgctggaatagtacagagtactgaatagtggtcagtccctccagagatcagtgaaaactttgctcctgccaccctctggtggccctgccagcactttcatctaatacttaaattgttttatttggttgcttgtttgtttgtttgagacaagttctcattctgttgcccaggctagagtgcagtggtgcaatcatgactcactgcagcctcgacctcccaggctcaagtaatcctcctgcctcagactcccgagtaactgggacttaaaggcacatgccaccacgcccagataattaaaaaaattttttctggagacaggatgtcaactgtgttgcccagagtggtctcaaactcctggcctcaagtgatcctcccaccttagcctcctaaagtattgggattacagatgtgagccaccgtgccgggcctaaattgttaatttgataatagcctctgaaacagagggagaacagtgcacacaagcaagtttaggtttcgctgtgggaatttacattcttttttgtttttaaaccccaaagatgtcaagatagttacttaaaggtttttgacaaaatcccaaggagattatttctgttctattaaaacatgtaatacatggagagaaaatatatcttttgcttttttagcaagagggtcctgagagagttaggagaggaagtgaagggtcaatggaggccatgtggtcagctgggagaatgcagcagccaggatgttattgaccacagcacaggctgacattgagtgggtgcagatctttggtggaattccaagcatgttgcacacctgacctcactttatgactctgggagggaagggagggaaactgaggtgcagtgagaaggggtgatcggtacgaacttcctccttcacacagaggaagaagagctagaatgagaactggaatgactggccctgaggggcctgttggggctgcacatgtgcctggtcagagcctagacctgcccattgagtgtgtatgaatcactgacttcgcagagctggaagggttccttgtttcaaggacaccgagactcagatggaatggcttgtccagggatagtgacggaatcgggactaagaatatgagtagctgccatttaagggctttccatatgccaggaactgccagcaaacactatgagataggtactgtcaatcatccgtggtgagcttgagcccatgcacttcatgggctacgccactgatcctttagtgtttgttctaagcttccagtcatgtgaaaaactgcccattaaacttggttggaatgatataaaatactgagtatagtactttttttagatggctccggagtcacagagacctgggttgaaattccagcccttgtacttgtttaagtttgtcaccttgaacaagctacctaacctctccaagctttggctttctcatctataaattggggatgacaggtaatggggttttgaaatttctagatagcacttttgagcttttgtgcaagaaggcaagcagaaaagagttcagttctatgtggcaagtaacataaacagggtctgtgaccttcccagagaccaagaaggccatcatgacgtctgctgttcaactacataggttcccaagtcccttggtacaaatcaggaggggacaggtagaaggactgagagaggtaggcttgtgatttgttacctgagatgatgatgtgagagtggacacacatgcagctgctccagatatggctggagaagtgcaggaacagtggggtcctggtcagcaggccggccattatgcccctgaccagctggatgcgtcctcctcacgtctcctgttgtaactgacttgcactgagttgcaaattgcaaatgggtgttgaccctggaagggactcttgaaagtcaccactctcacgactttctagtccttagagagtgggtgggctccatgcagcacagactgggagagtgccatgactgtgggcacttgatgtgcaagggctgcctgccttccagacatgccattgtccttcgcacattattgcctccaggagtgggagcagtggccaaatacacatcaggtgtatttctggacccacaggctgcagcaagagcaccggatacctaggagttgcatcctggcttggaaagcaggactcggccggttagtggatgagtccaggtcattgctcagctcagtgaagagagtgtcccttcagtctagccccaggtctacttcagctatgcagggattggttgcatgagggctgggacacaggaatgggggatggggatggggatttgaaggaagacttccctactgattgcttctacagtaggactatggacttttcctctgtaaaagacaagtacttttggctgggcatggtggctcatgcctgtaatctctgcactttgggaggccaaggtgggtggatcacttaagctcagaagttggagaccatcctgggcaacatggtgggattctgtgtctacaaaaattagccaggtgtggtggcgtgtgcctgtagtcccagctacttggaaggctgaggtgggaggattgcttgtgcttcagaggcggaggttgcagtgagccgagatcacaccactgcactccagcctgggcgacagggtgaaactgcatctccagaaacaaaaaaatagacgaatatttttaagagtcctgctttagtaagaaaggagtggatgctgggtgtaggggaagtcaggggaagaaaaaaacctccatcaaccctacgcaccctgatggtgttaaggactagtgttcaaatccaacgcacaggaaagggtgaggctttaaaaccaaacaatggaacaaatagcaaattaggtatttactcaccatataacaaaggtgttgcacaattgttttgttaagtggtgaatcaaaattcagcttggccgtgccttgtgctgtgggcccccaggcccatgcccctgcctccagcaggtctctaatccagcagctgggctgggtttttctgatctctgttccagtagcactgagggaacgtgtcctttggcccgtcacactctgttacccctggcttgtctcctgtctcattagactgcgttcttgaggacagggattgacactagatcctcagtgctcaacacctgcctgcctcgattgggtccacaatgaagatttgaaagaagagtgggaaatcagagaggcaagcaggtgtgtgcattttcctctttagctttctcctgtgagctctactctcatttgtacacctgcatattccaaacctctttttgaaggttttactgccacctcaaaatccgtttcgaagctcacccctcactcttgcttcttgtcttgtgtttcctgtttccttgtatctgaatatccctctccctgtcatcctcagcccatgtcgcccactgctcggctctcccatgatctccttccctcttctgcaaccctcattgcttctgccgtgctactgatttgtcttcatctggtctctagtcctcctaaacatttattgaagttgcttaacctaaagaatatccacgtgactgctgtgttgcaggtcctgtgttggaggaggtgggcccagatctctgacctataccaatctcttctggcatcagtttcttccatcctgttggattcttcacttcgaactcattactcttatacaggcaatgtggggaagattgaaactgattccttggttggcattcagggccttctgtgatcttgctcattcatccgtcttttccagtcatgtcccgtggctccctttcatgcatgctgtacgttccagccagactggtacataccccgtcatgccctacctcttcctctgttatcatgtggcttcctgcgggaatgccttctcctcccttcacttctcccatgcccttgtccaaattttgtccttgtgcttcagctcaaatgccatctcctccaggaagccttccctgctcttatctggtaagcatttgagtacctatagtgcccatagtccaccactggaggagacaccttgtttttgttttgttttgttttgttttgttttttgagatggagtcttgctctgttgcccaggctggagtgcagtggtgcgatctcggttcactgcaaccttcacctcccagggtcaagtgattcttgtacctcagccttcctagtagctgggatgacaggtgcatgccaccatgttcatctaattttttgtatttttagtagagatggggttttaccgtgttggccgggctgctctcaaactcctgacctcaggtaatccacccacctcggcctcccaaagcactgggattacaggcatgagccatcatgcccggcccccttagtttaattgcttaggctgtatatatcattttgcctctctgcatcctgtgtcctctccttgaggtaagttgggtctatgtcaaattcctcatagccatctttctgcctagtgcagtgtgcagcccacagcgtgctctgaggaggtgctggctgcataatagcacctgtttcctgccttgccctccctgtgctaagccctttccatgctttgtttcacttaatcctcacagcagccctttgacccagatgctattaattttgtcttcctgaggaggaaactgaggctcagagagattaagccacttgcccagggtcacacagctggtaggtggtagagctgggttctatgcccagaacttttgcctttaattcctgttgtatgacccgaatgagtgggatgaatagaactgtcaaaataggatgtgtaaagccagtggaggatgtaaacttcagaggatgccacaaattcagaaagaacgcttctcattttttaaatcactgtgttcagtgggtttcagccatgccctttaccaagaatagcccacagcttagaccatcattaaaaggggtggggtgggaaaggcagcaggagagtaactggtcttctcaaccccctcacagcaatgacttcccaggaactggtgtttcagggtctcacatcctagtagaccaggccctggagtgttggagaaagacagccaaattgcctttttgcctcttcattccttctttaatcccccaaatccttaaggagtcatgactgtcatatactgtcctaagtcctctgggaccacagaaatgactcaatcccattcaagagcctttgctgcaggagaaggagtgaaacccataaatgaataatcctaactttcagaaaaagagttaatgtgattctgagagacaggcttttactgtggaaatggggaggaaggagaaacccttatatctccagactacagaagagcccccaagcctcggcttccttagttaacacccccaacttctgactcagtttgtcaggacctgtttctaagcctggaggtttggacacccccactgccctgccaggagtttgctgaggaccttggttttaagcctgcaaaaggtgtgattagaggcattgtggcaggagcagcctgtctttaaaagagcgaggaaagctaggcggtgtctccctgtgttgaactgtctggacggctccagctctggactggtaaagtgaataaacgagcagatactaagggatcctttgtaccttgcactttatgtaacatagtcatttagttctcgatacaaccctattttgcagctaaggaaacagacatttgaaacagctgtaatttgcccaggaatgcatggctaaaaggtagctcttaattgtagtctgatgctaggtgtggaaaatcacttgggaggcatgaatggagccatgttgttggggagaagaaaggcctgttctgagcttaagggcagaatccttaggaaatatttccctgttctttgctgtgggcttgcactatggacggataccaaagaactgcagagagaaccttttactgaggagaggccagtgcagtggaagtcatttggttagaacctgcccaacagacagctgatcaggcctggctggtagaaagaacagaatgttaacaaatatggtatgcagtgttagggaggcagaagaagggagaatccatgggcctgcttcgattgctttcgagtcatgagttggtggtgaatgggacaggccttaaaaaagtcagagattatgattcaaaaccagacaataatttaaaaaatagatttcgagaatgctaccctccagaagggccctcagagagaatctgaggttttatttacttgtttaacggacagcaaactgaagcctggtggggaaagcaacaagccaaagatgacagtgtgttacccacagaaccagacagcttgctgatctgaataagcctgtaagacaggagtttagtggaggaatagaaggtgaatggagcaggttcataagagagcaaggcagtggattgatctgtatttttgagaaacctcccagcatggagttgggagtgttagctaggccaagtcaagatttctaggacacggggcccaagtgtctttggagatgcaaaagagtccatggtgaggggggcaccaacactgcagaagggggagggaaggataactgttggatagggatcatttcccagttctgagtggagtccagagtccagagagcgtgctgtaaggtggtgtcctataagcttatcatgtgctcttccctgtttcacctgtaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaaggtttgtggtacactatatccagtttcaccatagtcaacaaatatgaccaagcatccattatctacaagctggctggtggcggtatccctgtttacaaggaagggactgaggctgtgagcaaagtcatttgcctggtcttacagaaaacaaacagtacctgtgacctggcaattctcctaggtgtctacccaagagaaatgaaaatatgggcccccacaaaaatttatgtgtgagttttatagaagcattattcataaagccaaagagtggaaacaatccaatgccaatcaactgataagtggataaatgatatgttgtctattcatacaatagcatactattcacctataaaaaggaatgaagtgctgatacatgctacagcatggatgaacctgcaaacgtgctaagtgaaggaaaccggtcacaaaagaccacatatgatatgattccattaagtcagaatagggaaatctatagagacattgattagtggttgcctagggctggggagttgggggaaggacgggattattgctaaagggtactttattttagcactttctttttaaactgatgagaatgtcctaaaattgactaacggtgatgatggttgcatatatctgtggatatactaaaaactacagaatttgtgttaattgtatgatctgtgaattagatctcagttaagctctttaaaagaaatgttaggattcaagaccttggcctctcccctgtactgtcctgcctcttaatagagcctggaccagctcccttgttgaaggcctgaaggccaccctggaagttgctgcttttgacagtagctccaggaggctgcccttttaatcacagcaaccagtattttttgagcccccactctgtctttggcactgctccatgctttttttttttttttcctgagatagagtctcactctgttgcccaggctggagtacagtggcccaatctaggctcactgcaacatccctctcccaggttcaagagattatcctgcctcagcctcccagttagctgggattacaggtgcgtaccaccacacctggctaatttttgtatttttagtacagatggggttttgccatgttgtccaggctggtcttgaactcctacctcagatgatctgcctgcctcggcctcccaaagtgctgggattacaggcatgaggccccatgcccagcctgctctgtgcttttaacaaatgttatgtaactgaatcctcaaagcagcccctatcaggtaagtggcacctgtgttttagaccaggaaatagtgacacagagaatccaagtgtccaccacttcaaagtagtgggcctagggtctgcctccttgtatgtctgcctccaaccccagtgtctgtaatcactattacatgctgctgctgttcatttctcattattgtaaaattagattttatgtctatttctctgattctgaaaatgacctaagtgtttcagtggaagcctatacaacatagctagcttggtcactttcatggaaagaagaaagaaaaattgtcatatttattacagaatttgtttttttgttgttgttgtgtttttttgagatggaattttgctcttgttgcccaggctggagtgcagtggcacgatctcagctcactgcaacttctgcctcccgggttcaagcgattcttctgcctcagcctcctgagtagctgggattacaggtgcccaccaccacacccgactaattttttgtatttttaatagagacagggtttcaccatgttggtcaggctggtctcaaactcctgacctcaactgatccacccgcctcggcctcccaaattgctgggattacaggcataagccaccatatccggcccagaatttgttttttaaaaattaagcaacccatggcttctcagccttttggctaagatcaagtgtaaaaattaagcatcttaacctgtgagcttcagaactttatttgttcatcacctgtatgagtatctattatgcactgggtactagatataaagcagtcagcaaaacgaatttagtctttggtactataagttactgcctaagagactctaacttaccaccttattattaccaagcaatttggtttacagaattcagattctcccacagagttcttgttggttgcctcatgataaagacaggattggggtttctagaccaattgagatgagacagccatgtaacccaacaggtggttagaaaatgagtccaggtggacccaaggaagatacactttggcatggaaaagagcattatcagctagccaggtaaagaaatggaaggtatcagtgtttaatttcaaggtactctttctataattaaggctatgcattagcagagaaatcacagaattgttctggccacaactttggtcaagtgattttctctatttatctactagacagaaatctatgagcaggcaccggttcagttgcctactgttggttgttgccttcataggtgtccagatcctctgcaggggggtttaagaaggcctatttctggccgggcgcggtggcttacgcctgtaatcccagcactttgggaggccgaggcgggtggatcacgaggtcaggagatcgagaccaccctggctaacacggtgaaaccgcgtctctactaaaaatataaaaaattagccaggcctggtggcacacgcctgtagtcccagctacttgggaggctgaggaaggagaatcgcttgaacccgggaggcagaggttgcagtgagccgagatcgcgccactgcactccagcctgggcaacagagagagactctgtctcaaaaaaaaaaaaaaaggcctatttctctggcctccccagtttttgtagttttacctccttcctggggaagcactgtcttccctggttgcttgtgtctcctgttcctctctgtgctagtgaatttgtgccccttgctgtatgggggctgatgtccccatgctctgcctctgtagctggttcagaatgttgggttgtgctgtctgtaggaacttggtcacacattgatgtgcaggcgctcacaagtgctttggccacgatcacagaggcatatgcaacattcagatgtgtgtcaaagggaaagatacagaaaaccacacctaatctgcccataatggtattcttatgcttattatatgttgatcctttaagacttggctcaggggtcatcacctcctccaggaagctctcctcccaccaagtccaggtgtacctctatgacattccctagtcgtttttctttttttaatttttattttgaaataatttaagatttataaagaagttacaaaaataatataagaaattcctgaatactcttcacccaagttctccacatgttaacatcttacaaacctcagtacaaataacaaaatcaggaaataaacttgatatcaatactatctaatttacagacttatacatttcccggtcgttccactaatgcccttttttatggtccaggatccaatccagtccaggatcacaccttacatttagttgtcaagtctccttcatgtgatttaatctggaacagtttctccatctttctttgtcttttagggtcttgacctgcccccaccccccccccaccaccccaccccccgtttttttttttaagagataaggtctcgctatgttgcctaggctggtcttgaactcctggactcaattgatcctcttgcatcaaccagcctcccaagtagctggaacgacagacatttggcactgcgcccggctggatcttgacacctttaaagaatactagctagctgggtgcagtggctcacgcctgtaatcccagcactttgggaggttgaggtgggcagatcacctgaggtcaggagtttgagaccagcttggccaatatggcgaaaccccgtctctactaaaaatacaaaacaattaaccaggcatgatggcaggtgcctgtagtcttagctactcgggaggctgaggcaggagaattgcttgaacctgggagatggaggttgcagtgagccgagattgtgctactgcactccagagtgagactccacctcaaaaaaaaaaaaaaaaaaaaaaacaattttttgtagaatttgggtttgtctgatgttttatcaaagttaaattcagattacgcatttggtaagaagaccacagaagtagcattatgtcttgccatagttttgtgttttatttttagcttattttgaatattgatagattaacagaagttgcaaagattgtacagaaaagtttcatgtacccttcacccagtttccccaaatgttacatcttatgtaacttatggtacaatgtcaaaacctggaaattgacattgtatacagctttgtgccatgttatcgtcatgcatgcatatccagacagaagtttccatcaccacaaagatctccctcctcctgctcctttatatagtcacatcactcccctcactttaacccctagcaaccactaatttgttctctatttctataattttgtcgtttacagtctattttgtaaatggaattatacagtatgtgacctttcaagatttgctttttttctctcatcacagtgcttttgaaatccatccaagatgtgcacgtatcaacagtttgttccttttcattgctgagtattgtatggtatcttataccattcagccactgaaggacatttggatatttccagtttttgtctgttatgaataaagttgctgtgaacatgtgtagaggttttgtgtggatataggttttcatttctctggatgctgttatgtgttactgtagtttctaaatcaattagttttctctctcttattctagtccttgaaggtaaggagcatgccttacatctctgttgtctcacggcttggcacatagtaggggctctctatgtttatggaatcaatgagtcaaacaaaaatcttacacgtttaatttaaatgtgtaagatttctaacgatatagagccactggtctgctccagagaatgcagattgttgtagtattttgtatgccattgtttatacatttatgtgtgtcattttacaggaataattatgcatacatgtgcagtatattgccccagcataccactaccagtgtacgtttttggtaattatgtatttgtaggagatgtgacattgcttgttaagccacatgtgatatgagtgtttctgcctcagcaggcctgtactagagaaggcctgtcctgtgttcctattctccatacccattatggtgttgagggtgagtgaggatggactgttactctaatgtgatgccattaaacaaacaagttggaggaagatcagcttaccttctttcagactttgctaaaatgttctttattactagcatgttttctttgatgattttatcccacacattttgcttcagaatcatttcttggattctgttgtttagtatcccaaaaaggttgagtgttcttttagaacacatacacgcatgaactaagggtctcaaaagtaaatataagaaaagaacagatgagaagatggaccaaatgtagaagtaacatcacttgaggcttgagaactgtctggctagtgtaccatgtatactgtcactaaatggtgaccctaagccacgcatatgccaataattatatctgggaattgtaaactaaggctttttgtcctaaccatttgctcagcagatgagtattgctgaattgttcatttatatttctcccactccctgccaacagttaatgacagttcggactatcacaggaaatatctactatgcaaggtcaggaactaagattattgggaaggttcacgaaaagttcacgttgattgatggcatccgcgtggcaacaggctcctacaggtaagtctctaacccgtccaaggcttattaatctaaactcttcagaagaagcatgtcatgtaaaggtaaaagccttttcctctcaatgggagcctgtatggccatgcattctgatatgcgtgcatctgtgtatagcagctggttatcaaagcctcctgttagaggcagtttgggtgggggtcacttcccctgtcctgtagtccatagattaaaatgcagaagttgaacttgtattgagacaacacagtcagcaagtcctagatttcaagccttggcccaggtctgcaggggacgaactgggggttaacagcaacacacagtctggaatcctggttccttagggatctggacccagcttgccctgctcacttgaaggtaggggcagttgcaggcatctccattagtgttgaaggcagagccagagctgtcagctttagactcaaatcctccacgttgcttcaagccttgtaatttagagctttagtctagaaaatactgattatgtttctgacccacctttgaagtgtcacattggcaatggcatcttaaggtagagagcaggaaggttgaagagagggtggggataatgagcggtttacatgaatctctagaatttgtgccatttgtacatatgtggctccaatggttgtatgttctgccgcctctgcggtagattgtctgatggtttgcatgaggtgtgtctgtagaattttaaaaagaaaaccccatttttgaagaaacacacaaccctgagtgataattacgtgtcagccctgggtaaaggtagaaatgtgaaggcttgtggaaaatgaggcagtaagatcaagaaaatcttgacacctttctttttcaacagtaccctcattgctcagaacaaaatttgaactttcttcaccaaagaggctgtgggaaaaaacaaattgaactctttttcttggaatttccttttgtaagaagtttattaaaaaaatttgtttttaacctaagtaggatttatctatattaaccaaacttagctacaaatggacttttgctgttctaaaatataaaaactaccctctccaaatgaaattgatgacgatgatagcttccatttgttgaggaggttttataatcttggtgttggataggtgctttatttacattatctcattgaaggctttcttttttttttttttcgtgatggagtcttgctctgttgctcaggctggagtgcagtggcgccatcttagctcatttcaacttctgcctctcagattcaagcgattcctgtgcctcagcctcccgagtagctgggactacaggcatgccaccatgactggctaatttttgtatttttagtagagatggtgtttcgccacgttggccaggatggtctcagactcctgacctcaggtgatccgctggcctcggcctaccaaagtgctggggttacaggtgtgagccactgcgcccggcccagcctcattgaaggctttcaaaagaatcttccttctcaggctttgaaggcagttttcagggggactttgcattagccatatcttggttacaggagacagagttgactgtgttctatgatctctgtttgaaacctacttctggtacaaataccaccattagtggggtgatggcaagtgtcagctaactctcaaacgtactgactcgaagaacccggaaggaagcatagaaaggtacagttggttttcagttcatcttgacgtaggagccacacgctgatcagaacactatatcctggttctgatgttttcgagttgacttttgttcttaggcaggctctccctttgaagtcaacgatcctggctttgtttattttttgtttttgagacaaagagtcttgcccaggccggaatgcagtggacgatctcggctcactgccaagttccgcctcctgcgtttacgtcattctcctgcctcagcctcccgagtagctgggactacaggcgcccgccaccacgcccagctaacttttttttgtatttttagtagagatggggtttcactatgttagccgggatggtctcaatctcctgaccttgtgatccggccaccttggcctcccaaagtgctgggatgataggcatgagccaccgtgcccagccagatcctggctttcttatatggcctttagtagctgtctcccaaagggtgaaactctttcactcagaattactatcaatcccttctgtcagaatccatttgataaagaaaaaagaaatctctgaaaacttacttggctctggtgggatcacatgcccaccctgaatgaatccctgcatccaagggaataggatactctggccagtgtggaccacatgcctgcccctattgtggttggagagagtatgataatgaaagctttctggggtacaggtgggtgtgagttctgctagcagaggagggaggcggggaagggacaccgtacaggcaagggcacatggccactaatcagctctaaaatgttttgagccatggtgttttgtgaaaatggcagcacagccccatgactgtgggtcctccactgttagtgaggaagactacttcagcagccacaaggacaagcttgagggcaggaaggccactgatgttgccactcaaacagtagcaaggagcagggcattagcaattcatagggcctagggtctgatctggagtccagcagtagctcccctctgtgataatccctttatctggtttccttacctttaagatgggggtgctggcctaaatagttttcttacctttaaaatggggatgctggcctaaatatttagaagccctattttttatttttaattaattttttgagatggagtctcgcccagtcatggaatctcgcccagtcatggaatgtgcagtggtgtgacctcagcttaccgcaacctctgcctccggggttcaaacaatcctcccacctcagcctcccgagtagctaggattacagtcatgcaccaccacgcctggctaattttttatgtgtttttactggagacagggtttcaccatgttggccaggttggtcttgaactcctgacctcaaaggatctgcccacttcatcctctcaaagtgctgggattacagtcatgagccaccgcgcctggccccctttccagtttttaaaaactctgaggcaaggaccaggtgaggtggctcacacctgtaatcctagcactttggaaggatgaggtgggaggactgcctgagccgaggagttcaagaccagcctgagcaacatagcaagaccccgtctcaaaacaaacaaacaaacaaaaaaaccctctgaggctgagcatttagtgtgtttgttaaacagttggcctttttacttttatggtaacacacataaatgttatatatgtgttaaggctagttaaatacatgcaaatggtaggtatgatatcaccaaatttgtgacccttatgtggtaagatacctgtactatattattcagatggacagtgagtaaaacaaaattgctcatccttaccagctgctgtttgtttctttttaatctttaagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaatatctgtgttcttagcattaaataaatataaacttgtgcttctgtactttttccccccctctgacacttttctctttaaatctgggagtatgtcacaaattaatgcacctaatagatataggtatatagatatctatatctgaaggttttttaaatagtgtcagggtgaggaagaagtagatgatccaaactatagaagagaaaatagatccacttaaccttcctcagcatcatgaatattgatgttactctatagtttaagtgaggaaactggccagaaatagcaggcctttgcacatgctctgccttttctcttttcgaagaaaaagcctgagctatttcagtaggtccttggtactctggtactctgcttgtctaccaaaggaggcgttagtgtatgttcctatattcattcccaatattaactctggtggccccatgggcctcatttcatcagctgggtgtattgacagtgatttagccatctaatatcccagagtaggggcaaaagaggacactgacaattatcccagtttcctggtccagtggcaggcagtgtaatggtttctacatccttctaatcaggattggtatggctgtggaatcctgtttttgtctcattctcatggacagacaaaagggaagagagttaaatgatgccttcctccctctcctgacttagctacagcaaaaaagatctataacaggggaaggtgtctgccacataaaatgctgatgcacttgtatcatgagtgtccctacactcacgcgtgtgccaggacttccttatgatggtcaggctatttgctgggttagtgctgtaatctgtggctataaagaaaaggaaaggaaggaaattgatccatgtctgcttagaaacaactctgagctaagcctcgagtaaacatattgttatttgaaatcatcttacagacttaagtcacttcatatatgccatctttgatctttgcagcaatgtagcagagagctatgcaggttaggtagctgttatttccaattttcagatgaaactgaggcactgattaagtagcatattcaagatgacatggcttgtaaatggtgatgcaagaatttaaacacaggtttctagattctaagtgcagtactctgttacatgactatttctctacacggagtatggaagcaggagagagtgtaccttgagaaatggcagttactgcaatggtgaatggaaaactaaaacagcctcattaacaaacgttaagtacaggctgggcgcggtggttcacgcctgtaatcccagcactttgggaggctgaggtgggcggatcacctgaggtcagcagtttgagaccagcctcaacatggagaaaccctgtctctattaaaaatacaaaattagctgggtgtggtggtgcatgcccctaatcctagctactcgggaggctgaggcaggagaattgcttgaacctgggaggcggaggttgtggtgagccgagatcacgctattgcactccagcctgggcaacaagagccaaactctgtctcaaaaaaaacaaaacaaaaacaaaacagcaaaaaaagcaaagtacaacaaaaaaaagtaagtacaaagtcctaatctgtgatacttctttttgtttgtttttgaagcagtctcgttctattgctcaggctggagtgcagtggcacaatcacagctcactatttttttgtaaaggcagggtctcactatggtgcctaggctgctcttaaactcctgggctcaagtgatcctcttgcctcagcccctcaaagtgccgggattacaggcatgagctactgcattcagcctgtgataatgtattttaatttagtttgaaattttaactgaatgttctatggaactgttaataggatgacataacaaaggttctgtgtttagtgtgagaaactgggccaaagaaatgtaaacaaagttctttaatgcaggactactcagaactctgaagtaatgatcacagtgaatttctcagagcagggcaggtatatggcttaccacaaactacctaccacagagtgctctttttgtggagcaggactcaaaaccattattctctgaaagtgtggccaacaattagaaataagagcaagagccgggcgcggtggctcacgcctgtaatcccagcactttgggaggccgaggcgggcggatcacgaggtcaggagatcgagaccatcctggctaacacggtgaaaccccgtctctactaaaaaaatacaaaaaattagccgggcgtggtggtgggcgcctgtagtcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaaaaaaaaagaagaagaagaaaaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagacaaaaaaaaaagaaataagagcaagagatacatggagtcctaagaaaatgacccagtctctcaaagtaagcagtctttctggagttgagtccagaaagtatcatttatatggcagagtttttcaaagtgagatctgaggaccacctgcatcagtcttggggtgcttgggtgcttccatttaaaatgctgattactggtttcactcccaggggagcggggtatgagtgtggcagcctatgtagttcaaaaatatttgttattcctccctgggagaaaattatatccctctgtctactgtcagatttggccatcgcagacttagctgtgaatatttcagcatatatatctaaaagataactgttttagaaaacataatcatggccaggcgcggtggctcatgcctataatcccagcactttgggaggccaaggcgggtggatcacgaggtcaggagtttgacaccagcctggccaacatagtgaaaccccgtctctactaaaaatacaaaaattagccgggcatggtggtgtgcgcctgtagtcccagctattcgggaggctgaggcaggagaatggcgtgaacccgggaggtggaggttgtggtgagccaagattgcgccactgcactccatcctgggtgacagtgagactctgtttcaaaacaacaacaaaaaagaaaaccactttaccactgtcacacctaaacaactttgatacaaacttatcaaataaatattcagtgtttaaattcagttgtctaatttttttctccccctgatggtttgtttgaattagaggttgatccatgcaggcttgacattctcctattaaaggaatcaactgaagaggtggccggccaccccacctctgtaggcagttgggctggggagtatctgtcgtttacttatgggacttaaagcgactaacaagaaaagctagggtacaaggtcgtgtaaatgaaaagttacatgaaggaaacccaagggtgagggataaaaagtggagtctggaatgaggcttgaagagcccgccatgacatacacacctacttcatgaggccacacgtttaagctttccaatagtgaatacagagaagcctggtcagatacaccattcgcagtgtccttaagattaaagtaaatccagatacagaaaggacagttattccccacggtggcatatgcctgttgtcctaggtatttggagggctgaggcgggagggtggcttgagccagaaaggacgaggctgtagtaagctgtgattgcaccactgccctccagcctgggtgatagagtgagaccctatctcaaaaacaacaaaattattccaggcactaagataatttctttcaaggatctttttataaaaacgatacttataaaaatgacattctggtaatcacattccgataataaacaatgacagatactctggggcatgcccggaccctgaactctgcagaggcagttgtctgaagcagtaaatgaggtgaatgtattcaggtgtattctgtgagcatggaatacataccttatgttgaatatgtttagatctacattgttaggctaagtttacacacacacctagatgtatgccccagtttgcctggcagagttccagttgatgcctcttatccccaagtcccatctggttaacacctccttttattctcaaaagtgtcccagtttgaactataaagtatataggcatcctatatagaaagcacctcgcagacctaaggaggctgtccccagttcacccaacttcattgaattgtgtgtccctcaggccaaagaaacagaggctcctctggctgcggaatcctttccagtggatctttccacaactgtacccaaatctttgaagctgcgtcagcacttttgcttatgctaataactgtgtgaacgtgatcatttgtgtgcaaaccaacaaaccagacaggtttacatatgttacagcaagttgtggaagactgcaccttagactcttgggaaaatcctgatataatgcaatttagtacagcaattctgtaaaggaccaccacttttcagtctggggatggctgcctgttgtctagcttgatggtggcaaccaaagggcagttagcgtttctcttaggaagctaacagttgtagcgggttgatacatggatggttgtaatggacatctattatttttgcttcattcattcaatcattcatcctctggtaatctcacgctcagatttccctctgaggaaccgttctgttcccagctttcagtccatgtgtttctgctgaagctgacctaacccgaccctggatgtggaacatgggaccaaggcctaagtccattagtacattagattcctgggcttagtggttgatttagggatggatacatggcctgtcaggaatacgttgccaaggaattttggaaagaggtttaatgcttaagaggatgtggtggctaaaactggcatggccactttgttaccacgttacgcctgaatcagcagaacgtggatcaatatgatcagaaagaatcctggttatgtggtatgtatcctgatgcagctgtgtctcaagtcagaactactcttggacttttcattttatttttatttatttattttttttggaggcagagtttcactcttgtcacccaggctggagagcaatggtgtgatctcagcttactgcaacttctgactcccaggttcaagcgattctccagcctcagcctcctgagtagctgggattacaggtgtgcaccaccatgcctggcaaatttttttggtattattagtagagacgggctttcaccatgttggccaggatggtctcaaactcctgacctcaggtgatccacccccctcagcctcccaaagtgctgggattataggtgtgagccactgtgcccagccagactttttagtttatatgagccatttctgcttaagagaggttgggttgggttttctatcacttatatccataaaagtcttaactggtacaaaaatgaaaaccctaaattctatgccttcctgaacatggtcaataggtttagtctggaaattcaaagcaaaaaataccctttatcataggcacagaaaaacttccatattgtaacacgattttgaggaacattatctttctggaaagcttatcatttggaagttgcaaaatacacctttatgtaacaaaatgattagacttttatggaattgttggcaatcaactaaataaattctggatgccatctcaagaaatatcagttttaatttcagagcagttattttagcccattctttctgaaaatagttaattaggaagactaagaatctgttgagaccattcctagtttgtggaaataaaaccacaacatcaacatgcaggttattacttaggtattttctctaacagtagtctgtgtaggcaaaataaccccttggggagagttggactttgagaactttctaaggcagatgaactaattttcttccaggagagtgtagctctaatgattttaagtggcccatgtagttgagcaaacactggcctgggaattagaaagcccgagttctagttttagttctgatactaaattaactcattgattctgaccaagtccttttaacttctatgtacctcagtttcctataagacaagaaattcaggctaggtgttaagtatggtctcctccagctttaagattatgatccatgagaccagcctgaccaacatggggaaactgtctctactaaaaatacaaaaattagccgggcatggtggcgtgtgcctgtagtcccagctactagggaggctgaggcaggagaatcgcttgagcccggtgggtggaggttgcagtgagatgagatctcgccattgcttgccagcctgggcgacagagcaagactccatctaaaaaagaaaaaagattatgatccaataatacaggcatggccgatttactgtctcttcataaacaggaaggtttcattatatgagtaatagataaaatagataagttattttatttatttttttttctattttttgagatagagtctcactctgtcgcccaggctggagtgcagtggcggatctctgctcattgcaacctctgccttccgggttcaagggattctcctgcctcaccttcccaactggctgggattacaggtgactactaccacacccggctaatttttttgtatttttagtagagacagaatttcgccatgttggccaggctggtctcgaactcttacctcagttgatctgcctgcctcagtctcccaaagtgctgggattacaggtgtgagccaccgtgccaggccatgaaataatcttaaaagtggcatttatttcattttgccttatattcatgtataaaccttggtttccgtatttgggctgttagtaaaataagacaaaaataaaacaaggaaaaatcaatgtcatgaagaactaaaactaagcctaaagcatgatgtttatctgtatattactcaataggcactgctactgggctacgaatgtgaatgtgccatggtcctcgtcctcagtaagttccctgtgtaatagtggcggcaggtaaaccacagatcaactaaaactaagcctaaagcatgatgtttatctatacattactcaataggcactgttattgggctacgaatgtgaatgtgaatgtgaatgctgacatggtccttgtcttcagtaagttccctgtgtaatagtggcggcaggtaaactacagatcaactaaaactaagcctaaagcatgatgtttatctacactcaataggcacttgttactgggctacgaatgtgaatgtgacatggtcctcgtcctcagtaagttccctgtgtaatagtggcggcaggtaaactacagatcaactaaaactaagcctaaagcatgatgtttatctacactcaataggcacttgttactgggccacgaatgtgaatgtgacatggtcctcgtcctcagtaagttccctgtgtaatagtggcggcaggtaaactacaggcaactaaactacaggtcacttttctcacaaaagtgagaatacagttcctagactacaagggggaatgtttaagttggatagataatttagagctagccctttaagggataaagataatttaaaggatggatggagaattctaggccgagggactaacagatattgagtccctacattaattactataaaaataaatcaaagaagattcttacatgaacctatgcaggtaaattcagatttttttccccctggtggatttgctctgagttgaggtaatgagagctaacattgattcagtgcctgctatgttttgcactgttaggtactttacatgttatctcatgtaatacctctttaaacctcattttacaactaaaattaaatgacagctaggagctaggaaatggcaaagttacgattccaagtctggactggttgtccacaaaagcccctgctcttgccataatgatgccacttctttcaaagaattcagaattttcttcacagctttaaaaatgcatagattctgaagcctctcacttccttccaattagttgcctacctagaaagttatttcctccacttgagctcatcaccccttcttagcgctcctttggattactgtaatttctttttctttgacctcacctttcgtctgatggattagtgtaatctttcccaaatttgttaatctgaagaattcaggagcttctcaaaatgcaggttcccaagccatgctccaggacatcgattcagaattggatcaaggcctagaatctgtgtttttaacaagcatttgactcaagggtatcaaattggaggaagcactgagttggtggactaccttaattgatctacccattttcagtctcttctgccaacccattcgctccaccccacccccagtccgtttttccgttttgccctcaaggtccctgaagacttccatatcatttcgcattgttttatttggggcactgtgccgcactacctgggcccacagcaggcgcgcaatatttactgacaaatacaacccacgaggtagttcctattattacccttcaatttgaaattgagaataaaacagaagtcgacaagttgaggtagcttgtgacatcagtatttcgtatttaatccagaaagcactgcttcaacgcccagtgcgtgcaaggttccactctcgggccagcggtcctctcccaaagcccgttcttcctaagtgtgcggccgccatccaggacacgccacgctcgtaaaaggtcacctgaagcatctaccctccacgctcaagaggtaggcggaggagcgcgcccttttctccaaaatggctgagcagggtcacgtgggctcgggggcggggccggtgcgctcgccggagcctggaagtgggtcacgtggctcagacgggggcggtagctgtgggggcgtggccgtcacacggcgcgatccgtctgggcagcggctcttcgggggccacgccctccgggccctgggggcctagcgcgcgacggtggggtggagctagcctcgtgaccttttaccccaacatggctgcgcccgtgggaccggtgaagttctggcgacccggtaaggcccttggtggaacgctgggcagatgcggcggcctgacttcggtcttggcgccgcggccggcgccctggggccagcagacctgctcgcaggcctgacctcggcgagctgggcgctgccgcctctgtgcggggggagctctggctcaggctccccagtggtcccgagggatttgggggtgctcccctagcgtgagcagaaactctttgtgaccttgttaaagtggtccagcctcctcaggcctcgtcttcctcgttactgatgcttgtcctgcccaccccgcgagatggggaatcctaaagctccctctcgtgtctcgttagcgccctggggttgcgctgtggcccgacagacaatgctgctcgctgctggaggcttgcaagcccaagttatggagtcagactgtccgggttcgaattttcgtctctgccttgtagtagggtgaccttgggcgagtcacttaatgcctctgagccatgacttctttacctgtaaagtgggcagaacaatagcttctatgctgtgggcttaaatgacaagcagaacgcgttgtcagacttagaataaatgctcaaaaaaagggaaagtgtgttattttcttttaggataattgttgtccactccgaatgtctactagaaaagggaacagtccttcatattggctgccagccacttcctctcttacagactaacacgaatcacaatcacaaaatgctttacttgttttgtcttgatatttactcattaatcaggtttttactgaatgtgcatatgccagaccgtactagatgcattacttcctctctgcaaacagtttcttgtaaaaaacaaaagtttttaaattacagctaccagcttgatttttttctaccacctgcacccctgcaggtctggatgtgcaaagtatattgcagcaaaaatgaaatgacaccaagaatgtaatataagcaaagcttttaatttttcagtggttctctgaaattctgaccatgcatataagtgatgtgagagataaacccaagcaagagatatgtttaatgctttttaaaaatttgtagtctgtcacttgacagttttatggttcagcatttcaagtcatcagccaattatccatcctgagttttatttgcatccaaaactaggaacttactaagtaatgaatacttttaatttattcacgcttttagtaacaggtgaaagtgttaggtataataaagagctgaattaattgtttgaaatcagaccagggtactattttggttaaagaacgtggaattactcttaagagttctatttcattatttagttcatccattgagggtacacttattgaaaacctaatcctgtgttcaggagacaaatacagatgctcagggctctgctctcaagttactgtctctctcttaattgaatataaagttagatgtcctctagaagagattttacaatgagacagagtaaggtggtggtaaagaagatgagctctagagtcagactgcagtgcccatcatgtctaccacttactaagttgatgacttgatagtcacttaaattctcaaagtctcagttactccatctgtaaattgggtataatacctaccctacccaaagtagtgttgtgaggtttaaatgagaataacacacaacaggatcttggcactagataggttactattataattatatggaagtatggaagagggagggaaagttgaatgtatggataagaaatacttcattaaggtggtatttttggagtgaacattaaaggatgaataaggttttgtttcatagagaaatggaactcgaagcaaagggtgcagcatgaacaaaggcagaatgggatttgtgcctttagaatgtccagaaagccaaaataacagagcagtgtgatagtgttaagtgctagggtatattttggggtatgacaggagatgaagctagaaaagtaggtaagggcctcattgtgaaaggtcttcatgacaagttaaaaagtttagacttcactgtttttttgttttctttcttttttttttttgagatggagtctggctcagccgcccaggctggagtgcagtggcgcaatctcggctcactggaacttccacctcccaggttcaagcgattctcctgcctcagcctcctgagtagctgggactacaggtgtgtgccaccacacctagctaatttttgtatttttagtagagatggagtttcagcatggtggccaggatgatctcaatcttttgatcccgtgatctgcccacctcggcctcccaaagtgttgggattacaggcgtgagccactgggcctggcctgacttcagtgtttttaagcaggaacaaatcaggtttactttagaaagataacactggcagtggagtagagagtggatggaggaggaaattagagaaggtactagtgaaatccaggagggatgttaaaaaccttaattctgacctgggagcttagaggaggtgcctgttggagagacattttagaggaagatgtgggagaagatgaagtcagtaataactcagatttctgggctgggtgactgtctaggttagtgattctctaattttgctttatagttgaatcacttgggaagctctgaaaagtcctgatgtgcacttgcacctcacaccaataaattagaactttggaggcctaggagccaggcatcagtgttttttaaagtctctaaggaattccagcatgcatcaaaatttgggaaccactggtctaggtaaattgtgttgtcattagttgacatgggaatagctttagtacacagttattgggccgttgctttgtgttagtcactttcatttacacatcttattaaacagtcacagtatctctgtgatgacagtaatactcttattttagtgaggaaattcaagatatgaagtaggttgtgggaaatgcaaggtgaaagtcagggaagctgatataaggctagacattcaaatcatgaacatatcctgtaggcctgagcctgtgattacagaggtctttcagacagtctaagtgagtgaagttgcttactggaggtaatagggagtggtggggactgtggcagagtgtgcatacactggatagtatgtacagtggagatctacagtagagcttacatatgctttctaaaatagggagttgtactcaggtccacctaattgttatcatatgggttcagagttgcccaattttttttttaagaagcctaatatccagatctgaatgggaaaattttatgtgttgttttaaatgaatgatttaaaacattttaacaatagcatgtctgggtaccttaagatacccatttgtggtgtctaccttaggagtgtgacttaagggccttgtatgacctgcctgagagttttctacaaaaatcttttacttaatttgcaagtacacgtggatccgaagggcctgcccattttcgtttgctcatttgataaatatttcatgattgttgaccatgtgcatgacgaaaactttacaataggttttaagctttttttgacttgacccacagtaagatatagcacacatacacaactgaagaaaaagttgttcataaacagtattgctttctggaatgtgctctgatgctttctattctatttcattatttaaaaagtgctggtatgacatactacattgatttcataacccactaatgggtcaccagtaaaatttttaaaaaccaagttaaagggaatgaggaattagggatatcagccttgttaagatagggaaatgaagatgttcatagtttgcaaaagttataaagttgttactcccttaagcatagagcgtacgctcaaggaaaaatcaatcataggcagccacagaggggtgtttatagagggaaagcagccctgatgttctggtttggttgaaggaagtcttttatgaggagaaggtatactgtttatcaactgacatagctgttcttataaaagagctcagctgggcgtggtggctcatgcctataatcctagcacttcgggaggtcgaggtgggtggatcaccagaggtcagaagttcgacaccagcctggctaacatggtgtgaccctgtctctactaaaaatacaaaatgagctgggtgcggtggtgcgtgcctgtaatcccagctactcgggatgcccaggcaggagagtcgcttgaacctggaaggcggaggttgcagtgagctggcatctcgccactgcactccagcctgagcaacagagactccatctccaaaaacaaaagctgataatagaagagatagattggggctgtaggttagagacaagggaggaatacggtagtacaaaagacatgttaaaatattccagagaggatatgaaggtttaaaacatgatttgaaaaggcaggaattcaggacaaaaacacagcagaaaaggataaggtattctttgtcattgttttcttgagtaacaattacaaggaattattaagatgtagtgacaagaagggaaggaaagaaagcctgtctctttgaggacaggcattgttccaggtcctgttccatcttttgtcttgttgaaaggaaggtcaacattttggcaaaagcaacatgacagtgccccacttacctgatttttggccatcttgaacctctgaaacacaactctgttcctggaagtaaatggaaaagggtcagagatctaaagcagtgattctaaacttagctctagggggtctacggacccccccgaattttatattctggtaaattctggtgtgttttttaggagagggagttcatagcctttatcagattgttgaagcaatctgagaaccctaaaaagtgtaaaagtaagtcactgagctgaatattcttgttacaaagctcctgtgctttcacttagcatcacagattctgagttcagaagacctaggagatgatggttattggttattatcactgtagtgccccagcaggaggctgtatagcatgtgtttgatctagggaggatttttattcatttacaaggcagcaaactccagtgctgaaaagtgtgaccttttggaaatatcttccttacattgagttgaattctgaaccctgtgtcatttacttattactcctagttctgtcctagagttacagcagcaaatcagcatgaaaagttatggaagctgctcacaaaatttaaagttatgtttctcctgagttgtttttctgtttgagctaaaactgtatggaaccttcaacaggttttcatgatgggatatggcttccctattcttcaccatcatgatcaccagtttgtcattgttattagcaagaagccggggtgaagatctcttgtttaatctgcccagcatggcggttactgagaatagcatttcccatctatccactcccgattccatggttccaatggggactgtcatttacctcatcccattccactggccatggttgattgtattggggtggggattggacctaagctgggagaagtcagtccctgtctgtccagtataaaagagcctcccccaccccccattacaacacatacctgggactcccagtcccccttacgttgtctttatttctctccatagcacttatgaccacttcatgcaccaagttactttccactgagaggaagaattaaaaaagcaagtgagctccgtgagggtagggctggcatctgtattgttcactgcagtgtttctagtgcttagagtggtacgtgacatggagtgggcccttggtccatccttgctggtccttgctggaccacgatgaatgattggtagaggagttgtaagcgtgaaccctggcactgccggcagccgtctttccagctcctgtacagtagccaacctaaggggctggaaggaacctgcaagacgtgccaagatgagagaaggagaaagccatggctgctttgagtgcccagtttctgtcatctctgagccttattgccatcctacagtaacaagattcatccttttacctcagctaattcccactgggtttctttcacttctgttaagaattcagtaataacatggacatggaggccagaagtaaagacactgtgctctgtaatacacagttctgagtggccaatttggagcccagtgggactgccatctcgtttcttttttctttttttttggagacagagtcttgctctgtcgcccaggctggagtgcaggggcccgatcttggctcactgcaacccctgcctcctggattcaagcaattctcctgcctcagcctcccgagtagctgggactacagacacacaccgccatgcacgcctggctaattttttgtattttagtacaggtggggtttcaccttgttgcccagactggtctctaacccctgagctcaggcaatccgcccgcctcggcctcccaaagtgctgggattacaggcgtgagccactgcacctaaccctgtcttgtttgtttttgacactgcagtgaagcttttagggaagatttttagttcctcgtaggcacttttctggattctttcctaaagttaaggttgaatacctttgagtagtttgagataaaaagtattgcttcttctgtatatcttcatctttgaaagtttataaacttaacacctttttctgttcattgtatcagagaatctgaaaaaaaaacatttctgctgcaggtacagaggggccaggtgtaagcatctctgaagagagacaaagtctggctgaaaactctgggacaacggttgtttacaacccttatgctgccctttccatagagcagcagaggcagaagctgccggtattcaaggtacgtcaaataatcatgttcaacctgtgggcttgaatcgtgtgtctgcattagctttatgctcagcactgaagggaatgatggcctctttctagaacacagtgagctcagagaaacccttactgtaagggatgacttttcatactgtgtattttttagttaaccttataaatcttgaaagtccttaagattttttcagttgcatcgtacatactggaaaactggaggaattagaatgacttttgttttcccctttattcctttcagctgtggacaatttcagatatacagaaaagtagagaaaatagcagttaatttctatataacagattaccaacatatggccaatttttgctttatttttaaagtcactcctttaaacaagtttaattgggaatatgaggttgtttctgctgaagacatcagttaatactctgacttcctctgagacagtgacaggattttggtatggttactacttaccaagtgcacatccagacactcagttttattagcgctcacgaaacagatgtgtgctcagctacaagagaccaaagtgcaaactagaattcattcagaactgttcatttatggctagcaataattctccagtacagatggacacagttgacatatacactttgtccctgttggcacatccacatgggaagccaaattgtaatcaggaagtacagagccaagacaggttacagaaatgtcatacagcccctgatgaggggtgaattctccctgctccacaggatgcccttggaatgacccgagtaggtgtggccaccagcatctgtgtctctttctttctcctggacggtgctgggtgaaagttgctgtgttctatctatctgtctgtctgtctgtctgtctgtctatctatcagacagggtcttcctatattgttcaggctggtcacgaacccctgagctcaagcagttctcctgcctcggcctcccaaagtgctgggattacaggtgtgagcagccaaaaggtgccaagttcttatactcatggagttcttttgactagactgtgctgataattcctcttctattaatgtgttctttctccaaacagataggcaacagcagccttcttaatttagccagattgccttacttggagttttatgtggctcccaatattttagtcacaagtgaactgactgtctctgggtttcttcctcaagtgactaacacattcactatgtatgaatgttagcaagtttgactttcaggagatgaaatgataggtttactattgctttctcaccactgagggacagtttgagctgtgatgaagtgtccggactctggagctagacttcagggttcaaacccaagcttcaccatttgtgtgctgtgtgacctcacttctccattctgagcttcttttctttatctgtgatgtaggactacaggagcacctacctcataggactgttatgaggaccagatgagatcatccatgcagagcatttagcaagatacctgacatgtagtaaatgctcaagtacaagggaaattactgtttactcaagtatttaaattttggccttttcttgactattctttgtctcccaactgtacttacaagataacataaatgaaacagcaaatgaaaaaaaaaaaagcaacaagaagttaagaaatgtttatgaaattaaaatggtaagaagaagggtgtaagttactgatataaagcaaagcagagtttaagtacagttgagatcttataagatgttgaagatgaatcgagacaaaaaggaaaacaagttacctctacgccatcctttttccctttcaaacaaaaagtaaaagtagctttaaaaacagaaattggaggctcggtgtggtggcttacggctgtaatcctataggctttgggaggctgaggcgggtggatcacttgagacaaggagttcgagaccaacctggcaaacatggtgaaaccccatctctactaaaaatataaaaaattagccgggcgtggtggcacatgtttgtaatcccagctacttgggaggctgaggcaggagaactcttgaacccgggaggtgggggttgcagtgagccaagattgcaccactgcactcctgcctgggcaacagagcgagactccatctcaaaaaacaaaacaaaacaaaacaatgttggaactaaagcatcaagagattgttaaagatcactgcctcttccccagcaccattatgaggccacctgttcccttgtctgccttctttaggctgctgtatagacaatagtgactctatcttggatgcaagtctgccatgttcacttctgtttagacccagtcttataaatgcctcctgatttctgctttgtatattgtccttagtgtaagaacatgtcaacctctctgggggcagcactattgacagcttcttgttttgttttgtttttccccaaaaacagtctacgcataaacaagtagatacgtgtttgccctaagaagaatgcagttactagggtattattcacactgttctacatctcacttccttttcttaacatatcttatagttcattccatatcagtacaagtagatatttcctcttcttaataactacaaattattccattattggaatattttatgactgatttaaccaaacttttgttgatcaacatttaggctgtttgaatttttggctattataaacaactctgcaatgagtatgcttgtatttatgtctttgtacacatatagtatgtagcagtatgtctataatttcttgttttttttgttttgttttgttttttttttttttttttttttgagacagagtctcaccctgttgctcaggctgaagtgcagtggcatggtctcgcctcactgcagcctccccccgcctgggttcaagcaattctgctgccttagcgtcctgagtagctagtattacaggcactttccactgcgcccagctaatttttgtatttttagtagagacagggtttcaccatgttggccaggctggtcttgaactcctgacctcatgatccacccccggccctggcctcccaaagtgctgggattgcaggcgtgagccacctcacccggcctataatttcttataagtgaaaatgtaaagggcgtatgcattatgtattttgataagtgttaacacgattgcagttgtattcgctcatactgagaggaacagtacctgagggttagaaatacattttgatagttctacttaaaattcactttcctttgaaaacagctcatttcacaatgtttaaatatcgttgtttaggtcttttgagacaatgtatggctatttgcaaggtgtgttattctttttcagcttaggaatcatattttatacttgatagaaaattatcagacagtggtgattgttggtgaaacaggatgtgggaagagcacacagattcctcaggtgagtacatatttaataagtgtctttacacttcgatttggctggaagaattttgtaacttgagagctctctttactatcatttacatttttaaggtctcctttcaggaaatgttcacttcaactagatattttttattaaacttttagggcttataatttctttggtgagtactaaagtaacagtttgtcttcgatttattataattccaaaatagtaatggaatggccatcttctgaaagttacaatggagatttattcaaagatgtgaaatatagagtttttatccttaaatagttacagttgaaggggtggggtaaaatgaattttgctgtagttgtaaataaaaattggctgttatagtattatgcagtgctatggaagaaccctttcttactaggaaaaatcctatgtgatgtggataggagtagaaagaaggatcaagaaaggccttgtaaaggaattggcatttgaaattgaccttgactgggagctgactgagaagatattccaagccagtgaatattgtggttagaaatactggggtggagaagtgtagggtgagttcagagtgtgtcttaagaaccttaacttgaagagtgaagactgactgagcttgagagaccttgcaggttcttacttccttttttaatgttaattttcttgaggtatgacatatatgtaggaaagtacctatatcataattgtacaccttgatacatttctgcaagtggaatacatctgtgttaccagcacccagatcaagaagcagaacattaccaaaacctcaagaactcttcttctgtgttctgttctcatctctaactgccatgtctgcttacccctacaatcatgaacacaagggtagctcttattctggctactaacctcataaattagttttgcgtatatttggaattttataaaggaataatatagctgcttttgtccaacgttatgtgtgagtcttccttggtgttgaattagttgcagtttgttcattctcattactgcatagcagggttcggcaagtcacagccagtgtgccagatgcagcccgctgcctgttttgtagagaaatctttgctggcacacagccactcctacttgttgatatattgccggtggctcctttcaggctaccacacagggttgaacagttttgacagagaccctacgatcctcaaaacctaaaaattaccatctggccctttacagaaatgtaaaatgtaatgctaacccctgctagttagtattccactctatgagtattctgtggtttgtttatttttcctgttgttactgacatttgagtcattcctagtttttagttatggatagtgctgctgtgaacattcatgtgcttgtctttggtgaacgtatgtgcacattctcctgctgggctctacctaagagtagcattgctggatcctgtgttcaactttagtaaataatgtctaagatattcaaagtggttgtgtccttgtagggtttgcaagcaagtaaacaatatgacaagctgagctttagataaatgattatattgagatataaggtgacttagaaactggaggaggcaggccatagaaagctattgcagtggtctagagaaggatggtgtaacggggtcctcaaccaagaggtgatagtgggataatctggtgaggatgggaaggagaacaatttacaattttagcgttagggtctgtagacattagaaacttaggttggtgcttttgcaccaatctaatagatggatatttgtgatgacaaaggggaagggacaaaggtgcacagtgactgatcacgacttgctgccttggcgaacagtgctagtattaaatgtgatagaaaagtaaagattgtttttttgaggggaaattaatgtgtgtgtttttaaacatatttattttttcctatattattgatggcctttgatgacattagcaggaagtttggaatgggaatctgaagcttggcagaggtcagacgtagaaggtgtggacatagggattgaacatcctgatacatgcaggaaggagatggaacagaaataactgagaagaggattaaggacaaagtccatggagcatcaacattcaggagtcaggagcagaaaggagatagaatggcagccagggaaatgacagaggaaccagcagactcttcatggttagagaaagcaaagacagagtgaggtttctggagaggtgggtaggtggcagtttcagccaacagagcggccagggagcaggagaactggttcagtcctgggttattcatcttggagatagcacgtccagtggtagggttttagggttaagggtgtctaagggtaagatgataaaaatccctttgcatatttgaatatgttaacaatgtgttgttgactgtttggtccagacttgtggtcatgccaggatctgtgtagatctttttttttgtctgctccccaactccattttgaataatgggtttataaataggttgggacccagatgtaggtatttttttaaagtttcccaatagacagctagggaaaggtagacagacctagtaaaggtagatgacctagtaaaggacaacttgaaatgcatgcagcagaggaaatggtggcctggaggaaaaagataaccgtatatgcagatggaattgagagcctagtaagttactcatttcttacaggaagaaacaggagaaaggttaaattactgtgtgattgtcatttagagagtaatataacaatagtataacaagtaataacagtaataagtgctacataaagtgattttacacatgttgatctgtttaatcctcaatgaccctatgaagcaaataccattattatcttcattttataggtgaggacactgtagagagtaatgaggttatggaatatagaacagaggtaaaagaccacatgatgttccagaattgtttgggaattagtctgtgacgttatgtagtcagcttaggataaactatgttctggtaacaaagaacctgaaaatctcagtggcttaaaaacacaaaggtttatttcttgctcatactgtgtggttatcttgggttggctttgagattctatcacatcatcattgggccttaggctgatggtactgctcttatgaggcacttgttgatcttgtggtagatggcagaatcatgagacagctcttaaaacttctgaccaaaagtgggccttctgttcacatttcattggtcaaagcaagttatatggccaggcctgatagcaacggggtgacagtgtatataatcctcccatagggatgggtggcaggtatttggaacaatgataaatatatcacagtgatttggccatttactcctgcaaggcttagctgccagggaacagagagggcctgctgtgttactaagtccagggaaagctggtgggaaggagaaagagcagaggctgaggatctaggctgggtaatgtgggcaaacaaaggtagtttttttttcttttaattttaagatttgaatatttttaatatttttgaacattaataggttcacatgatttaaaattcaaaaggcacaaagggacatacaaagatttccttctgccctgtcttcctggtacccatttcctttgtgcagttataatcagtattatgagtttcttggtagaaattttttcatgcatttacagagaagtgtctgtgtgtgtgtgtgtgtgtgtatgcacatatatgccctattttaaacatgaaacatctatacatgttttagtatgccttgacttttttttttttttttacttattctttcattttaaaaaaaaactgttttgaattgacacataactgtgcatatttatgggatttagtgtaatgttttgatatatgtatatgttgtataatgatcaaatctgggtcattatcatatccatcacctcaaacatttatcatttctttgtggtgagaaccttcaaaatctcccttagctattttgaagtctatggcacattattgttaactatagtcactctgctgtgcagtagaacaccagaacttattcctcctatataactataactctgtgcttgttgaccaaccttttattctccctactccctgttcccctcttccctctgcagcccctagtatccactgttctattctctacttttgtaagatcaacttttttagattccacatgtgagtgagctcatgcagtatttgtccttctgtgcttggcttatttcacttaatatcatgtcctctaggttcatctgtgttggcgcaaatgacaggatttcattcttttttatgactgaatagtattctattgtgtatatatatcacattttaaaaaccagttcatctgttgttggacacctaggctgattccatgtctcggctgttgtgaatagtgatgggagtgtacatgtctctttgatgttctggtttcctttcctgggaataaatacccagtagtgggattgctgcatcatatggtagttctgtttttaatttttcgagaaacctccatattgttgtccatagtggctgtactagtttacattgtcaccaacagtgtgcaagagttcccttttctccacattcttgtcaacatttgctgtcgttcatctttttgatagtagccattctatctggggtgaggtggtatctcattgtggttttgatttgcattttcctgatgattagtgatgttgagcattatttcgtatatatgaaataatacactgtgcatcttcttttgagaaatgtctattcaggtcttttgcccatcttttttttaactttattaaaatactgagttttatttcacatttattttacatatttttgtctccccaccatttccatgtctgaccaccactactattatgtcctatcatgacattccatacatacctaaaaccaagcaaagggtggagttccatctttaaaaatgaaacaggcattttggacaacgcagtcttggcaatggaacctggacaacatttatcaaacacggtagggaaagttctcactctgcattataaaaagaacagccagatatcaactgttgctgcttgcatttttgctttagtgttttctacagaacttttgatattttaggaatttttttcttgttttttgaaggattcttgtccttttgatcttggtgttggtggtattgagtcttttccattctgatttgacttttgtgcattttttggctggagtatcttgtatagctttctttactggggctttttcttcagtttcctcatcatcaaaatcatcatcattagcagcagcagcaagttttacttttttctctggaacgttgctaccacctccaggggcagatcaccttccagatatacttaagaatttcacatcttcttcctcttcatcttctgactctgcatcttcctctacagctactaagtgctgtccactaatatgcactggccctgagccacacttcaactgtaagaccaccggtggtattatttcaaagcccctaagggaaatcattggctgtacagacattttcaaagttgccagtgttactttaattggactgccttcgtaattcattgcctctgcttcaacaatgtgcaattcatcctttgcaccagcccctgagctgaccgttcttaaagataactggtgctcatcttcatcattatccaccttaaagtgatcatctttgatggcctttagttcacaaccaaaaagatagttctggggcctcacagggctcatgtccgtgtccatcacatctttcatggggtggtggcacgtacttaggtgggagagaaggcggatggagataaatgacccctgctccagagaacagctgtgcagggcggaatcacacccttttgctcattttaaattggatttttagttttttgctattgaattgtttgagcaccttatatattctagatattaactctttatcagataatagtttgcatttattttctcccattctgtaggttttctcttcactctgttgattgttttcattgctgaacagaagctttttaatttgatgcaatcccgtttgtctatttttgcgttttgttgcctatgtttttgaggtcatatccaaaaaatccttgcccagaccagtgtcatgaagtgtttcccttctcttttgttctggtagtttcataactttggtcctttcatttaagtcttttatccattttgatttgatttttatatgtggtgagagttagggaactggtttcatttttctgcgtgtgattatctagttttcccagcaccatttattaaatagattgtcctttccctaagatgtgttcttggtgcttttgttgaaaatcacttgactttaaatgtgtggatttacttctggattttctgttctgttccattggtctgtgtgtctgtttttatgtgaggaccatgctgttttgtttatagctttgtaacgttttttgaagtcaggtaatgccttcacacttggtcttttttttcacataatgtattgttggtttttttttccagttccatagatgctagtatgtgaacataatttaccaatccccaattgatagacatttaggttgtttacagttttgtattatcacaatgatgcagtggagtcagtttgcacataaatcattttgcacacatatagatatttttatagaataaataaaatacttatggggttgctggctcaaaacacatgtgcatttgaattgaattattttaaggaattgcattttattataaactttttaaaaataggaaatacatttacatagtacaaaattcaaaaagaacaaaggaataaatggtgaaaagttaatctcctaagctttgctgttgaaaatgactagatcattgtaatagattgtattattggtccaaatatctgctacccctcttatggagtattcccttttctcctagccactcagttccccgtacctgagacagtcactgtttccaacttattgtgaagctaaatttgggctatgatctaggaaaattggaatggctgaggaactaaaggttacagcaaggatacggagcaggtttttctctcttgttagatttatatagtacctttccttgggaaaaaacaatgtgcaaaagcactggatacttaataattttgaaattctacaaactatatgtagaacctagatgattttttttttttttactagagttctgtaaaaaaaaaaaacaaaaataagggctatgaacacaagctcttcttaagtacaatttttattagtactgttattggtggagttcttcctaattctgtcctttagccagaagcccagatttggtgatccttaaaaagagtggagaactcagatggacttcagctacgttttagtgatctccctccgtgactctccactgcctcttgacgttagcactacacctgctttttcagtagctttaaatttccacctctcagcaatcataagcatgccatagaagtctgaatcacacagggtattgaggtgactagctttatggacaggcttatttttatggaaattgtttttctttcacttaacactactgctaagagattggctatgtgtgtttgaagtaggataatatgttgtgttctgtttatgtgtcatgactttggtttgctgagcttgaagtccaggatacagatttttatttgtttccttggacaaattatgtggcctctttgtttcctcatctgtgtattgttgatgatgatgttaccttccttatagaatttgttttgaggattaaatgggtcaatgcatataaggcactcagtacagttcctggcacttaataaggtactcattgactcttagctattattcttatagttctgttttttttttttttgtatttgtgttgattggggtggttggtagtattttgtatatgtatttaatacaagataaactttatagtttttatagcaaaaaccctacattatcttcaaccctttgtttcttacagtcattttctaaactttatttttaactacttttagactaatagaaaaattgcaaaaaacaatacagaattcccttatactcttcactactagtgcagagatcgaaagcaggccattaacattggtacaataatagtaattagactataggccttatttaaatctcatcagttttcttactaaggttcttttttagttctaggatcctacattgcatttagttgttgtttctccctaatcttttctaggttgtgcgaattcctcaatatgtcttcatctttcatgaacttgacactttaaaagactaatgggatttactttgtagaatgttcctcagtttgggtttatgtcatgttttctcatgattagaaggagcttatgtatttttggcaagaatactacagaaatgatattgtatccttagtgcatcatttcaagggttcataatgttgatatgtcttgtcactggtaatagcaactttggtcacttggttaaggttccagcttttgcctgtgaaactactgtctttccctttttagttgatatgtatcttgggggacatattttcacactgcaaatagtctacttttcttccaactctcacctactaagtttagtatccccctcagtggatcttgtctgtagcagtgatgattttcttttctcctctttccctctatctttattaaatgtaattttctgtaaggaagaactgtgctttcttcctcacttatttcttagattatttgcgtgtatcaatatggattcatagatacttatttttttctatgtgttaaagcccaatactgtcattatttattgtgttgctcagattgtttcatctttgaacattagaagctccttcattttggctcctgttttctttctaaagctttcatttttttgaccgcttccttactttctagtactacaagatgtttcaggcttgtcttatattttttcctacacaagccctggttccttttattggagaatgatgtttagaaatcatgatctggggccgggcgtggtggctcacacctgtaatcccagcactttgggcggccaaagtgggtggatcacctgaggtcaggagtttgagaccagcctggccaacatggcaaaacctggtctctactaaaaatacaaaaaattagccgggcatggtgttgcatacttgtaatcccatctactagggaggctgaggcaggagaattgcttaaacccagaagtcggaggttgcagtgagccgagatcacgccattgcactccagcctgggcaacagagcgagactctgtctcaaaaaaaaaaaaaaaaaaaagaaatcatgatccggatgctagagtgctcattgctacgagatgtcattgctgagtctcagtgagcagacttaggaaatatatgtatgaatattaagccatacattataaaaacatctagctatctgtatctgtctatccatctatattttaaacaccatgagtttatgcaaatgcttctgattccaatctaataccatagggctcttttgagcctttctttatttataacttctctgcaacaatgagaagcttagtccttatcatctacagtatatttgtggattcattaaaatagtttcagaattgctaacttgtaaccttgtttggatatttactaactagattacagcatttatgtacagttctttctgtctttagccttacaacatacagtcaagatatatttttccatcattccttaggtaagttcttttcttctccaccccctgcagtgtggttatgttattcatttgtagtatagaaagggtcatctgttagtgtttatatttcctttaggtttccctccacatcctggttggttttatttgtcttctgggtgtttaaaaagtatgtgaaacatgcatggctgtgattctcagagtcagagctacacaaaaagatctattgagagcattgacacgccctctttatccctgttcccctccctccatttccccttctttctacacctttcccacccattccctgtagacaaccatttcttagtatctatattatccttcctttatttcttttgaacacatgagcaggtacacgcagtaacttttaaaatcttttttctattgtagaagtaatacatgttcattgtaaaactattagatgttagaaaaacatgtaactgataaccactgttatccgtattggattttaagtgcatataatcaaataaatacatagatattaaataagtaggtaactcagataaatacacttaatcaaattttttttttttttttttgagacagaatctctctctgtcacccaggctggagtgcagtggcaggatcttggctcactgcaacctccacctcccaggttcaagcgattctcctgcctcagcctcctgagtagtcacgattacaggcatgtgccaccacacccacctacgtttttatatttttggtagagacggggtttcaccatgttggccaggctggtcttgacgtcaagtgatctgcctacctcagcctcccaaagtgctgggattaccggcatgagccgccgtgcctgttcaatcaaattttatatatgtgtactaatctaatggtgtatagtcatatatataaaatccagttgttttatttaatatggctgaaatgtgttgtgtggttgatatttatgttgagccatctctatatgtgcttaaaaattctttgttctacagagttagcactgttttgagtgacctgtggataattttttgttccctgaggcatctgtagtacatggtgattttccaggactggggtgtcagaatgctggaattgcgccttagttcttctgttgatcagctttgatgtgaacttaagtaaatcacctaacattaccaagcctcagatcctccatctgtaaaataattcccaaagttctgctgggacaagaactgtactttttcctttcttagtgattttaacacaatacgggagcatcttgggggagattgctctgcaaaagtggtatcatatgtatacttagatgtgattttgtttgtagtaccttgcagaagccggctggacagctgaaggaagagtggtaggagtgacccagcctcgaagagtggctgctgttacagtgagtttctttttgtgttggaaagattctatctgtgttgtctacatttgtgatttgtttacatttcctaaaggctttaaatgaatagaagttgctccttaagagtttaggtcttcagtttttatgttttttttatttttatttttttcctcagacagagtctcactctgttgcccaggctggggtgcaatggagctatctcaactcactgcaacctccgcctcctgggttcaagcaattctcctgcctcagcctcccgagtagctgggattacaggcatgtgccactacgcctggctaatttttttatatttttagtagagacggggtttcaccatgttggccaggctgttctcaaactcctgatcttgtgatctgcctgcctcagcctcccaaaatgctgggattacaggcatgagccactgtgcctggccaggtcttctgttttaaaagaattatgatttgaatatttttgttaaattgatcctgcacattatgaacgttttaaacaataaagtgctgaggaaataaaaaaacaatatatttttaaaaccccaaatttcaccatccaacataaacaatgtgaacatttgtgaacatcattccaagcttctcctaaagatgaagatgaatggttgactggctggatagaaataattttataaaaatgagatcatatttaatatttattttttattgaatttaacaaaataggaaactttagtgaaataggagtagcgactgtactttggataaatgttcaccgcaagataatttattaaagcttgaaaagtaagaaaaaagagtacaaaaaaattcaagatgttacctatatttcaaattacgccttatagtttcctgttatgaaagaagaggaaattagcacatgtattcttctttccaccttccctttctccatttgttgtagatacagtcctgtcattttcatttcaagatttataatatacatgttcttaatcataattctcacaggtgtttaaccttaattctagcttgaatggattcattactcatcattagttattttctatggttttgctaaccttgaattgcttgttttgcttttatttcttgtattggctgaattttatcattcagcttttttttttttttaatatgcttgagaatgttcagttgtggtttttgttgatataaaattcttgattcacactgtccctgcaaactgcagactttgctcactgccttttggcgttgaggatcactgtgtagaagtctgagccaccataagttttttgttgatagtatgtttgaattcttttgttgtttttaaattagctctgagagattgggtgtggtggctaatgcctgtattcccagcacattgggaggccgaggcaagaggattgcttgagcctaggagtttgagaacagcctgggcaacatagcaagaccctgtctctacaaaacaatttttaaaaaaattagctgggcatgctggcacctgcctgtggtcccagctacttcggaggctgagccagaaggatctcttgagcccaggagttaaggttgcggtgagttatgatcgtgtcattgtactccaacctttaccctatctccaaaaaaaaaaaaaaaaaaaaaggcttaaagaaaaggaagtagggcctttagtttgtggcctttacctggacaaacaattaattctatttccccaagttatttttgttctgtactgagttttaattattgtgtcgttgttttgcccaaagttcattttctaatggtgttcaattaagaagttatacagttttagaagttatgtgtgtgtgtgtgttgtgtttttgtatgaaaatggggctaacagtttggaaaccaagttgcaaatgctgctggagttaatcttttttgtcactaaaagatgactcagttacctaaaattagaacaatttttcctgtttgtggtttggaatcccagctcttaatcagtttgcatcttagttccaaatttgtagccatggataacttccatgaaaccacagctttctcttgaaagagcaaagagcatgtaatatattaatagagctgtcaagtttgaaatgctacatctcagaaagtactttatgtgcagactaaaatctgcaaacaatctcagagcctaaaaacagattgcataagctgttgcttgatctctgtgagaggcaattagtagtgagtatgcttgttgaactcatgtggtctgggtttgacttcaagaccaggtaggtcctccctgacctgtgattcagaataagctctaacacctgtcttatttcagtttcctcatttgtaaatacaacagtgtctcgtctacctcatgggctgtgtgtctatttaatgagatacaaatttgtgaaagcttagagcacagcacttgccagtagtaggtgctcagtgattttttttttttttttggtcttttacctccctttccttttggtctgtcaaaaagatagtatttgtccagtctagttgatgaggttattgggagcagaactaaagtgatagagataaaaatctattaaaaagccaagagaatataaccttgtgtgattataaataataaaaatttaaaaatagagtttgaaaataaaaatacatactttttatagcaaatgtattcaaatagtgaaggagtaagaataaacaggtttggcttttaccttatagacccataaaatgattatatttttacagagatttgttaatttatgctcatttttttaaatttaaaatttttgtgggtacatcgtaggtgtatatatatttatgtatgctcattcttataagcctattttctccataagttcctagtatctctatgcacacattctctacctgtaccatattctgagatttataatataacgacatgtagggttgaaattggaacagtaacaataacaaatctgtcctggtgaaatgctggtcattgggaaatacaaccaccagaggcagagcaatgtaggataactttctggtttcataagacgttttgaaagcctacatgatatagaccagctgccagatgattgatttggttttggcctccccattctataatttcaagtcaccaggcagagctgcttctgatcctcatctgctcttcagtgtcttaaacactgatgggcaggaaacgcctgggtgtgcctagctcagaagctgagggcagggagcctctgccctcctgagcctggggctgctggggtggaaaggctggagcagtaagctctgtctcaggacaccacatgtgccagccatgttctaaagtcaggacttgggaactgcgtgggtgctggggaggttgtctcacctgtgaaagagggagactgaactccttccttctgtggggattggtgtgctgggccctgggaaatctctattaatattgcttccctttggttcttttcatttaggtagtttatgtggtggtgaatactaaactttcttttctttctttttttgttttttgacacagtctctttgtcaccgaggctggagtgtagtggtgtgacctcggctcattgcaacctccacctccccgggttcaagtgattctcctgcctcagcctcctgcgagtagctgggattacaggcgcatgccaccatgcccaactaactttttgtatttttagtagagatggggtttcaccatgtcggccaggctggtcttgaactcctgacctcaggtgatttgcctcccaaagtgctgggattgtaggtgtgaaccaccgcgtccggtcctattttcttttaaattaaactaaatgatattcattattgctcttccacttttatgcttgttcattcttttaaatattttctattaataagttaacttttgaatagccttcttgggggaatgcagagatcttgctgttggattcatttttctctttcctgcattcattttttatttgttatgttttgatggatgaaattttgtctatagtttatggtcttcataatgtattacatattttgtctttcactttattatgctaccttggattttttattgatcttctcatccactcatctgccccctttgttttaaacctgagtttgtctgtatttcccctctcagtggctttggcagctgggacacagttgtgaactgtttcaggtatctcattcttgaaacttagctttttgccttcgatgagaaaatgaaactggcccagctttgaatatggtaattcctgttctgccttcatggtcccgggggatgggttttcttttcgagcgtggagatgaaaagttgtccctggttagtgtgccctttgtttaggaacagggtgaatcttgtcatttcttttactttcctttttgctttggccaccaaatttagagctgaatttgtggctcaacttgaataattttggcatatctatgtttaacattttctcattggctttgatcttttgaaattttttctgtaattttttggatcttgatccgtaacatttttatgtgattttgtttttcattgtgtatgttcttataagttgccccaagaccattatagaatgaagtgagatacataagttaataattggctgggtgtggtggctcacgcctgtaatccctgtactttgagaggctgaggcgggcaaattgcttgaggtcaggagtttaagaccagcctggccaacatggcgaaaccccatctccactaaaaatacaaaaattagctgggcctggtggcgcttgcctgtaatcccagctacttaggaggttgaggcaggaggattgcttgaacttgggaggtggaggttgcagtgagccgagattgtgccactgccctccagcctgggtgacagagtgagactctgtctcaataataataataataaaaattgcaaaagttattatgcttgttctctaataacttgtctcttttcatttttcattgtgttcacatactatttaaaatataaatgacctttagattttccatagtatgtgcgctgtgcagtaatttctatgtctctattttcagcatgatctttcttcccaaaggttgcagggagagtagctgaagaaaggggtgcagtgctgggccacgaggtgggctactgcatccgctttgatgactgcaccgaccagctggccacgagaattaaggtaaagtgctcaagctgcttttcctagtggaaataaggaagaaggttattttgggagaattaaaaacatgtagtccttgctgctgtacaggacattgataccatggcagaaagtgaagaaaagtatcctgacattcagagactttagtcagctaggagacagagagctcttccttttttcttttttttttttttttttgagacagagtctctctctgtcacccaggctggagtgcggtggcacgatctctgcttgctgcaagctccgcctcctgggttcacgccattctccttcctcagcctcccgagtagctgggactacaggcgaccgtcaccacacccggctaagttttttttttttttttttttttgtatttttagtagagacggggtttcactgtgttagccaggatggtctcaatctcctgactcgtgatccacctgcctcagcctcccaaagtgctgggattacaggcgtgagccactgtgcccggccgacacagggctctttcaaagagtcctgcaatcttatcccagaaaggagcttggaagtcaggtttagtccttgattccaaagatgaagaggttaagggcttggaaggttgaatgacttgcctgatattatatgccaatcagtgataggaccaagactcaaagctgtcttttcttatgtgtattttattgtattttcactgactcaaatagcaatcgaaatatagaaacaagcctgtaaaaggcttaaaaatagagtagtataagttgatgaagtgtagaattcatgaatgttgtttcactaattagtacttttccattttcatatgaaaatggattttacatgtgtgttctttggccttgttgctaatgttaaaataattagtatcaatagtaatcagtgtataatcaactcaacagggtgtgtactacctaccaccgtgctagaatcaaagtctaatcagacagtgcaataaaacagtgaatgaaaataatctgatgaaatgaaaattgattattagaatctcagttacctcttaatttgcaacagaggaaaattgaaaatcagatgagctgaatgaccaatgtagtgatttgtaaaaatgtagaccttattttccagattgccatattttgttatattcattttgctaggtgaagggaatatttttctgtaccatcaaatatatttgaactagctaattttcagtggtttgcataaccatgaaaacctttgagccgtccataaaaaccttttgtattccatttggtcacaatttcaaggtgctcagttctcgactggtgatttgtcattggtggaagttctcactacgtatgtatgtggcagctagtaccaggtccaagaaaaatatgatggcaatgcatcctgctcttaaaacaaaaaaagtaaaaaacacctaagatacagcatgcaagggagatggtttaacctgaaaacaaattcagtacgttaagaaggctgttactgtatgtgtctgaagcattttataaagattcattaatctgaaataatattagctgacttttcttaaacactactctgtcctaggtcctatgctaaacgctttacatgtacagtcagtcctctgcatcctgcgggttctgcatctgtggattcaaccaaccttgaattgctaatattacaaaataaaaataaaaaataatgtaaatttaaaaaaatacagtataacaactatttacataacatttacattgttttagtcattctaaataatctagagatgatttaaaatatatgggagggtatgcataggttacatgcaaatactatgccatcttatataatggacttgagcatctgcagattttggtgtgggttgggggggtttctagaaccaaccccacaaggataccgaggaactactatactatcttatttatttttcacattaacttggtgaggtaaatactttgattacctcattttacaaatgagcaatcagggacagagaagatgagtaacttgtccaaggttcacacagcttagtaagaggtagagccaggatctgaactcccagcagtctgacaccatagcccatgtgcttaaccatgatcctatctagagtctgtaaaataatattaattgaagtttaagttaataacctcaagaactgcaatctatagtctttgggacatttgaagagcaattatcttacacttagggtgtttctttgggcagataccagttagtcttcactgcctctttatcgatagtactggtggtgcaagcccagaggaaatggggcatagctgatgttcccataataaaggcaagtgaaattctgctcaaagatttgcaactccagctgaggaccctgtgtttaaagccttttgtgaacaattacattgcttgataacgaaaatatgggggcattttctcacagtcctttgtgggaatttacttgtacacatgctggcaaagaggttgcacttgaacttaaaaaataccattaatatgtagtgtaagtgaattatttctaaagctttgtgtttttattttttagtttcttactgatggaatgctggtcagggaaatgatggttgatccgttgttaacaaaatataggtaaatgtgtttttcttatgatagctttcctagtttccaaagtccccaggtagacggagaagcaggtgtgttagtagctgggattcacgtctgtgttcagctgccccaaagcttttctcttgaccttggctgttgggacccttggtgtttttctcagaatttaaatagtatggccctttacagacactcaaaaatgggcacattaaaattcctatcattacttagtctggtgacttgtcctttttattttgccttgtcacactccagtattgatggtgactgcagagaactaactgccctgtgttaaatgtaatatacagagtccaaataattttttatcacttccccctctttgtctatctgtctgtcactcacagcattaaagctgtcctacctaggctctggtgttctcgaggagagtgtcacatttgaccccctggcccacgtgtgtcacaactgtagtcagctacctctttgactgttgttatagcttaacagtcttcagatggttgggctttgttctgatttttatgtgttctgtggggttataggttggttatgttttcatttaaaatcagatattaaattctgttggaattcagtgtggatggtaaaacgcttaaagataacaatagtacactttttaaaattcaggtatgttaatgtcaccgtttttattaacctaagaattgcctcattgtcaaagaagagtgacttaggtttacttttgatgcaaagtgattgtatgaggactaaatacccagaagctctttgatggtctagatgagatgatgtgtggcttttttagaggctcactgagagcttctctttgattcttagtgtcatcatgctggatgaagcccacgagaggaccttgtacactgacattgccattggcttgctaaaaaaggtatgacttcactgccagcttttcattgtgtgtgtttattttattgcctaattacaaaagcaactgtagcaacttggaaagtacaacaaaataccaaggaagaaaattaaaatcatccataatcctacccattcagagaatatcagtggtagaatgttggtatattttcttctcttttctgtgtgtgtgtgtgtgtgtgtgagtgagtgtgtgtgtacttggatctgttttggcatactagggattgattgaattatatatactaatttgtatcttgcatatttcccttaacattacattaggatcatttttctgtgtcatttaaatattctctgaagatattatttttaatggctatttaatcacatctctatcataaagtatttaacttcccctactgttagcaatttatatggcttgcagattttaaatattataaatactgttgtagcaagcacccttgtaattgaatctgctgcatttctgtttattttctttaactttttattattaaggtttcatacatatcccaaagaagtgtataatgacccccatgtacccttcatctggcttcaacaattacaactcacagccaatcttgtttcaatcttaacctccactctctcctcccttcccatattttctgattgttttctttggacagattcccaattagagtctagaaagaagtggtagaacagggtgattaagagcataggcattgagtcagactacctgggttcaaattctggctttgctgagtttactcatctctaaaatggggaaaatagtagtctctatatctgtgctggtatactttcctttatggtagccactagccacctgtagctattgagataaaagttaattaaaatagaagaaagtaaaaaaattcaggttctcagtcacgttggctatttttcttttcttctctcttttttttctttttttgagacggagttttgcccttgttgcccaggcgggaatacaatggcgtgatcttggctcaccgcaacctctgcctcccaggttcaagcgattcttctgcctcagccttcccgagtagctgggattacaggcatttgccaccatgcctggctaattttgtatttttagtagagatggggtttggttcctccatgttagtcaggctggtcttgaactcccaacctcaggtgatctgcctgcctcggcctcccaaagtgttgggattacaggcgtgagccactgtgcccggccacattggctatttttcttttctttttttttttttttcacgttggctatttttcaagggctctatagccacaggtggctagtggcttatgcatcggacagtacaaataaggaaagttttcatcattgcagagagttcttttagacataggtactgtatattgtgatttgttatgaagcttaagtaagatagcaaaaaacttttaggttggtgcctggcatagggtcacagctagactgtgaggttcttttgtgcaaattagaaaaagatgttccctctgggaggatgtctagagctaggtgggaggcaggtggaccggattgctgaagcccctagccccctcagccaggcatctttgcacagtgggtacactgtgtacctgtatgcagggcctctgggctagcacataagttagtctgtattagttgttattattattattttcattgttattttattccattgccaaagatttagattttttgatactttaagggaattattgtaccatgttattacctttttcaggaacggtataataagagggccgatttcactgaatctttgccaacactgagtattagccttaaaaaaataaatccttgccaatgggatagatggggaaaaaaaaatctcattgttattatatatcttagctgtagctcatttggtcacttctccaatgcctgttgattatgtgtttctttgagtaactgttaatatcttttatctcttttttttttgccatatttctgtcttggtgttatcatttattgtttgtttgcttttaatatactttttcatacatagattcaaactatcttgagacccaggtgtcaggaaaaaatggttttattctcagtaaattcaaatttgggtcttaaagcttctttatagtttttataatttaaaaaaatttactttggaaaattgcatacatttacaaaattggaagtaatagtgtaatgacccccccccccctttattgacaattattaatttgtagtcagtcctttcatctgtaagctcccttacctcctcctcaggcaaaaaagaaaaaaaaagacactgaatttttgaaatacatttcagatatcaaatgatctcatccataagtgttgcactattatcattatttccaaatgtcttcttttttagattcagaaaaagcgaggggatcttcgattgattgtagcttcagccactctggatgcagacgtaagagccttgcctcccctttcctcctctcctcacaaacacttttgtcctatatatccttgggaagttacctctagcaagagcttatctttggcagaatgccctatcttctttatgggaccatctgatgtcctagatttcatataatcagaggttactccttttcagcttgtgaaattagactgtaattaattgagctcataattacctacctgtcttgtttatctacatactgtctttctccccacttacacagcttctttttgttgttttttcagtataagcctgtatttcttgaatttgtttatttatgactatactgtatagatttagatttttctgtgcaattgaagtttctcctgggctgggcacggtggctcacacctgtaatcccagcactttgggaggctgaggtgggtggatcacttgaggtcaggagtttgaggccagcctggccaacatggtgaaaccccgtctctactaaaaatgcaaaattagctgggcgtagtagtacatgcctataatcccagctacttgggaggctgaggcaggagaattgcttgaaactgggaggcagaggttgcagtgagctgagatcgctccattgcactccagcttgggcaacaagagcaaaacttcatctcaaaaaaaaaaaaaagtttctcctgtatatataataatttccatgttaaagttttctgtggctaggtttacattatttttctctcttgtggacctatagtttaaacagcagctcaactcaacaaatacttttgaccacttactatatttacatgcagaaatagatgtttgcagttcagtgtgttcaaagttctgaggcagctaaggagggagcccttaactccagccagctggggggtgtccagaaactttcgcagaggtggtgacctaccagctgtgcttgaaagatggacagccgttttccagatggatgaaggtggggaagggcaccctaaatataagtgaaatcacagggacatgaccatgagttcatggagcttcgagtcttatcttacctgccaggccctcatgggtgaattacccttgaactccctctctgactttatcttcttccactttctccagtgctccctacatttcagcctcactggtctccttgctgttcctcaaaacaacccaggcatgcttctgctctggaggaaccctctttttagaccattccttccccggacagcctaaggttctctcctaatttcattccagttttgagcatttattatctcctcagagaggcgctctctaaaacagcaccccagttgctctttattcccttattctgattttttttatgtttctcacttgtctatcactatttaacattatatgcattgtttattgtgtgtctcctgtcactaaaatataagctccatgaagatcaggactttgtcttattttatctcttccacctaaaacaatgtctagcacagagtaggcacttgggttgaatgaattttgactgactgggaagtaatggaagattaaaatggggaggttggggtcagatgacggaaagccttagaggctcagccagagaggatgaactccatcctgtatctggttgggagccatgggaacatgtgagagagggcagtgacttcatcatgtttgagctctataaagatcattctgagtgctgtgtataggagatgagagtagatatggagtctctagtaaggaggccagttctgaaatccaggtgagatgtggtccctggctcctggctcctagtctccctgtggcttctgggatacagaacaacttggagagagagaaagcttaccatagcgaaggtaaatgtccaacgtgtcccgagactggtttctcagacctttccacaggctgtaggagtctgttgttttaggtctgcccatggtaacttttgggttaaagctcctctgttgccctgtttaattgtcatctccctcacccatggtatctgctggcatgctattttgtggactgtggctgacttcacctctagttagctcctctgtggctacattacacagaacatctgtatctctttttcaccccccaccttaaaaattattaaattaagttaaaaattattccagtttttattatgttgaaaactataatgtccaagtcttttcttagattcattttatttatttatttatttatttatttatttatttattttttgacaccaagtctcactgtcttgcccaggctggagtacagtggtgtgatctcagctcactgcaacctctgcttcccaggttcaagtgattctcgtgcttcagcctcccaagtagctgggactgcaggcatgagccaccatgcctggttaatttttgtatttttagtagagatggggtctcatcatgttggccaggctggtctcaaactccggacctcaggtgatcctcccgccttggactcccaaagtgctggatttacaggcatgaaccaccacgcctggccagattcattgttaattaatacttactaattgttcacaattgccttttattgtcttggtggaacacagagatgaaaaaaatagcttctttcagttctgtctatggtagttgatatagatgactttctggaagcaattttgtaagcgggaagacagcatgtaggaactttgtcatgccttgctctgctgtggtacgggacatgctggacctctggtaagctgggccattccttcttatcctgtccttgctgctcagccagtgcctcctgtgtgaggggaacggtggtttctaagtgtctgtgaatgggggatctgtgtgtgtgagtcatctctgtgtgggttgtgggtccgtgtgtgaggggcctacgtgaggtatgggatgtgagttcgtatgtgagtgaaagaaagaaagaggatataagtgggcgaaagagggcaagaatgaggactatgtgggagtggcaggggggttgggtgtggcttaggaaacattttgatctagaggcgtagggaagtccagaactcatcccctgccccccagcggctgggtctgtgggtgacagactaatttcaaacctcctagagctagggctgctgataggccacctgccgtggtttctctcagggactggggtggcccagcctgcagacaaagacagcagtggctgcagccgggaggcagagacctgcagagcatgatggggctgatcgaatagctgctttggttgctttatctgctttcttaatgtaagcccaattaaacgaacaattatataacatgactggatataattatgaagtatttattgatcctgtatcacgtgatgatattgcttttcttttatttgcgtccaactgcatggcagaatatatggttgctggtagctcccatagtttttttgtcataagtccagctacttgaagagagactaatttctctttccagattcttagagaaggaacttagcatcagctggggtcaggtctccaccctggaccagtctacatgggccaaggctgttggccaatcatgggtgtgttgggtagacatagctgcttatcggccactccagtgggttaggaaggagcaggtaccagggaaggagcctatggtgagctagaagacaaccctgcagatggccatatcatttacattccatttcatagactgtcccctgcctttttatgatgtatgcttcttaccatgtctgtatgtcaatgtgaccccacctctttcaaacctgactcaaattcttcttttctgggtgtgttgaacttattttactcttcttgttccttgattctgcctcaagattcttgcattgttggtactatatttatttacttttttatgtattttgtatttccaaataaagatacaagataaagatcttaaaggtcttgtgccttctcagtaaatgctgagtcttaattctttttgttttgagacagagtttcactcttgttgcccaggctggtgtgcaatggagtgatctcggcccactgcagcctccgcctcgcaggttcaaacgattctcctgcctcagccttcctagtagctgggattacaggcgcctgccaccacgctcagccaatttttttgtatttttagtagagatggggtttcactatgttggccaggctggttttgaactcctgacctcaggccatccacccgccttggcctcccaaagtgccaccgcatgagccaccgcatccggccgagtcttaattcttgaaagagtaactctttacttttcagtaccacatagtccttaacggtaaggtttaggcatctactctaacaaaattgtcaaggcatcatcttcttccttgttctgcttgcttttttggtaacattcacccttgtccaagccctttggtaaaatcttcctccttctccttccatagctcctggagccctgctgacttccctctcctacctccttgttggcttcctcttgggccccttctctgtctgctcttccttctcaaggctgcacacccctgtggtccctggttcagctgagccttcgtgcttgtggcagtcttgactgtgtgcttgcacaccagccttagctgtctgacagctggctagccacagacatcctaaactcataaacttgtgactctctgattctccatctcagtctctttctcatgatcatagtcatttaggccaagacctccattgctttaagaagtttttatccccggtcgagtaagagtcactctagccttctttccaatgtgcacgtgtgtgcacgttcactcactgattgccagttcccaccagctgtatctctggaatgctttgcccaggttcacactttgtctcccctgcactattatgatagcttcattaattagtttgtttgcctcgaatctcttatttcctctgccctcctccaaaatggccactggagtctgggattcagctcacaggtctgataatatcatgcccatcctcactgcccttgtcttgcccatcgaataaagtgccagtgcagctgatcacttgggtcccttcagagttatggctgacatcacttattgagtgccattctaggctagatgtgtgtcacaactatcccacatagtttatttgaacctcacagcaaccttgcagggtggatagcagtttgtccattttgcagatgagagagctgactcagagatgaggaggcctagaccttgcctctgtcctcccttagggacccctttacattttagtccatactgtgctattgtcctgggaagggatgtctcccccttcccagccagtaataatcctccttagcctttacagtgcaggcaagggatactgctttctccatgaagctctccctgaaagccggtagttcttaacttttccttctatcagattgcaatctgcagctctttcctggtcacagggtcatctgcctcagggattattttatgatcaactctttgcacgtctgccttctgtgaactgtttactcttttggggcatggggtgtctgttcccacttgtttgtatgtcacttctagtgtacctgtgctgtgcatgtcatagggatgcaggaaggctgaagcaacttgaagggaatttacccaaaagaaagtgaacaggagtactgtgtggaattctgcatagcaaaacatagttttgttgacatgaggcactttgatgtctgtgcttattcttctcaattttgaggttaatatataacatccctgtattttgtggttaaatccagtttactcttttaaaagtacccctcagagccccttcacttagcgtttgatgccattcgttagcacagctcctgggctcctgggtttcctggagcaggatgggcatgttttgtaaaggtacatagggaaataaagacaagctttgtagttatgtagccaggcctcagggaaatgagtagaggtggggaatggaaagggcacccagattcaaataatggagcactccacccgacgggatatccatgccccctctgcagtgggcaccagctgcttcccatctggtgctcacttgcctgcctgcatggtcacttagctcttctcagtctcagcttctctttgtaccttagggtcacattccccaagagaggatctttggtggcgtttccttcccccatcattggctggagccctcaagacaggtctccttgtgggctgcaagtggtggtcaagtaccattaaataggatgtggacacctgtttggcagaaactgccaagagacacttctcccaacagggtactgcacgagtgttggggaagtacatgattgatggcctaccccatacaaagcctcgcactcactactgtagggcgtgtaaagatggagaagacactatccctgccatcaagtggcctaaaaccagtaacaatggggccggaaacacacctactgttcacagaaggaaaagtttcctatcaaatgatcatatctgtgttttccagatagagttacccaccaacctcatctaacctgtactgaacttgagtcacacctttgacctaatttttgcttaaatgaaatacagaggataggaataatataaataatactaaagctacatgttaactcagatgctatgctgaatgcagttttgaaatctaacctttattatttttattaaaactttagtaaagacactgtcattgaaatgtgattccccacaattacagttagaaaaatgtgaatttaaaaaatgtattttgcaacccataatctgtattgcacatatataatcttgctactcacctgtctttggcaagttttatattattttttctttccatgaatcgctacgaacctttttttctaagagaaatgaagaattaatttttttctttttagaaattccgggatttctttaatcaaaatgaaaccagtgatccagcaagggatacatgtgtgatccttacagtggaagggagaacatttccggtggatatcttttatctacaaaggtttgatgatgcttgaattctggatgatggtgtttagaaaactcagcctctgatgtagaatgtcagaactgcatttgctcacaactctaaaggatggggaggagcatgttttgtgtccctagtcattggtctagaatgttcttaccctgctccggatcactgctgaatttagtttaaactgttcacactgacatgcaagtttccgtaagtctgtggccagtagctcagccagagagagcaaaagtggtgaaaggttttggggagggaagcttgatagttttcagaactggggtttacaaggctgcctgtcagcaggggcagtattggtgatttgaatcatttggctctcagttctctacatccctagcgagaaggcccagttggcatttttaggagtagcctacttggacaaggaaggggccatcctaattcctgtactagtcactggacaaaaaaagaccaggagcctgttccagtggctgataaatccagagtcgtggacttgatttctgaatcgttttgttggagagctcatccatcagggccatccagccgacccatagatgctgctattggttaggagggaaaatgggctgggaagagcgtgggcttcagcactgggaccacagcttccgattttcactggtctgatgtctttgcatactaaagatagcacatctatttgtatgggtatatcatgttatttctttccaaataaagctaaaaatcatagttgacatataattatggattattcttgaatattagatttgaaaaaaatgaatatttattttgtttatcctgtactaattacctactgggcaggcccaaactcactttgatgagctttgctgccagattattagggtaattgatctgtaattaatgagcatattctagtgatgaattcatcccatttgtcttttcagtcctgttccagattatatcaaatcaactgtcgaaactgtggtgaaaattcaccagacagagggagacggagacgttttagcatttcttactggccaggtaatgccactgtacttctctgatgaatagacatgttaagacagcaccaaaagtaatacagagccttgttactttactcagtcatgtatttcatgttttgttgtattttgtggttccataattgtgtagaaaattgatttgatgtcattcatctaccatctagattgtcagggactcgttagcccctgcctgttctgtctgcagagggttaaatgtttttttaaatgtattagctgattccaaaataaactaggtagttgagtgagggctattttgtttgccagaattggatactacattaggtccatgtcctgcacacatgttgctgctgtgtacctctttttccagtgacacctttacagctcatcctggaggtgataagtggccatattactggtaaaacaactgaacagacccaagtgctcgctgacggtggccagcactattcagacctgccctccaactgtaatcttttccactgccaaacactttccatggttcagtaatcttttttggagaaagcttacagtgattttatatgctgcaacttgtctatatgcatgagatgcttgtttgacaccgtatatgtatgctgagtaaaatagtcatcgtttttatttattgggaactcttccattcattgcagatcataccgagtttttagtaactaatagtgtagttgcaaaatttcacccattgtcatcattgtgtattagcatttaattaaataccatcccagagtggaacatgacggcactgaaattcttgaatctgaccaaaattaaagtccagatcccaacttttattttctttcagtatgataaaatagcatgctttaaattgatctcggtttctttggttcctggttcaacgtctttaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgagactatcctgatgaccaagggtgttggcagccgtctataatcataatgatgctcctttacttgttttgaaacttgctaaacacaaggcagacttctaggtccatatttctgtgtagtagatctaaaagcacacaataaataatacattgtgaagatttcttttttttttgagatggagtctcgctctgttgcccaggctggagtgcagtggcgcgatctcagctcactgcaagctctgcctcccgggttcacgccattctcctgcctcagcctcctgagtagctgggactacaggcgcccgccaccacacccggctaatttttttttgtatttttagtagagacggggtttcactaagttagccaggatggtctcgatctcctgaccttgtgatccgcccaccttggcctcccaaagtgctgggattacaggcgtcagccaccgtgcccggcctgttgtgaagattctaaacctgtcccactgaaggatcactttgacagtagttatcagatcaggtgacttctcttttcttctcttctgccttcctaatatttcccacgacacatgcttactttggcttaagggattgtttagggggattgaggtcagtcaggagcaatagaaaaattggtacacatggtttctaaataatttgttttaagtatcagcttgcctattttaaagggccaagtttaaatcaattaattcaaggtgtggcttaaaaatgtttagccttgaagtgagagtgaggaagggtgtggtggaaagcattggtttgaaggagctggcaggcagccagtccacctgggcctgactctgccttttcctttcattagatgaggactgcacagaaccagcccgaggacagcttttactgtagtagctatttatcaacagatggcagagaatagagcaggtgagggatggtctgaggatccactcccaatttcagaccacctggaagagggtgctcagccccttgaccattgggatggagcaacatgagtctgccctgtcaaacattaattgcagccagccaatcaggagacctggattctgcccctgagctactatgtgccttgggacaactgacttaacctcgaatctgagtttttgcagctgtaaaacgtaaataataataactttcagataggtggttttatagcataacatcttaatcccaactacataaaaatattagaaagattattttataaaatgatcatttataaaataatttttataaaatgatttataaaatgtaaagtgcctgaaaaaagttctaactgctatatatatgtgtcccctgctacttaaacccttcaggggcagctcccaatgtactgggaataaaattcaaatacctcatggtggcccagagaccacatatgattgcatatctgcctccctctgcaacctcatcttgtactttgtattttggctgcactggctgtttctccttcctttgaactgtttcttattcttggatctctatagggttggctgctgcttgttactcaggtctctgctcaaaatctttcacagaggctctgcctggccaacaaaagtaaagtagcatgccctattattacaataatatataatatacatgttatatactacatcatatcatattgcctcattgtgttaatattttctttatagtatttgttgttctctgaaattatcttcttgtttatgttcagcatgtcttcaccctaaacactcaaactagaatgtaaactctggcagagcaggggccttgtctgtcttgtttatcctacatcccagcaccttgaacagtgcttggcaaagtgcacaccctcagaaagtaatcatgatatgaatgaataaatgactatacctgcgcaagatggagggtgatttactttggttatgccaaagggaaaaactaacaaatgctaggctctgatcactttatatattaattgtatatagtcccttcagtagccctaggggaggtggtaaatcttattatgtagatgaggaaacaggttcaggaggttgagtaacttgtccagggtcacatgattagggagaattcaaacccagggcaccccctgacttggaaactcacagtctttctagtatattaaactgcctctcacagattctgcaatgttggaaatgttaaatcttttaggatttttacgagtttgttaaaagcaaaaagaataaaatgagttttattcttctttctgtggggaacgtaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacaggttagtgtggctttccctaagggtttttgactttcttatagtcagcctgggcaacagagtgtagcaaatgtttactcctaatggtagaacttaacataaaatacaggccttcctcacaaggccctgtgtaatcagatccccactgctttcctcactctaaatatggtgtttctttgttactagtccccattggccaaagctggcctgtgagtgactgcttatttgctatcctgttctaacctaacatctgggcacaggcctgtgtagccatttgtccctagggtgtgggctgtgtgtcctggagcctgtctttcttgcctttctttcttgacttaatgtgctgtttttgtattccaagatccctgagtcttgcggagcctcacattgggttccccttttacttctggttcagagcatctttgccaagtgaaaatggaaggtctgtccggagactcattcatagaaaacaaatagttggtgagctcctcctctgtgctgtgcatcatgctaggctctgagggaacagaaggcaattttaatactgtctcagcctttctggagctttctatccagcttgaagacagccttacctatagacagtgatggacccagagctgctctttctctgcacttctcttctgtggggaatgctgctgacattttccccagttgtccagactcaatttccaagtcattgttaattctcttctttatccagtatccatctgcattcacttaaccaggcccagggttttttattttgttttgtttcttctggtgtggctgcccctaaagaaggtccaggggttttagctctgccatttgtctcttcttttcctttctggttattattgtccttgttcagtctttgatgttgatctttcttttagcagatgtttgcagagcacctgctgtatgctggccacggtgctagagcttggagatctggggctagtaaccatggtctgtggccacagtgactgacagtctggtggtggaggtagacctcaaaacagatcagcatattatggtatgatagggagccataaagaatcgggagccttggaagcagagagcagaggcttttccttgggctgttttccctgcccagcagatcttccttatctttcaaatcctctctcagatggcagttccctcatgaagctaccttagatgccttctcctagaagctggtgttatccttctggggatttggggagtacttcacaaccagggtgttgtttgagcctgatcttactggcaatacagtccttatctaggcgaagaggtgattggggagattcaatttcagcgcaccaggcagagggaatggaaggtacaagtacttgcagggaaggaagtgggtttggaacattcacagaagggagggaataggcagaacccagggcctgaggaccaagggcaaccactgaagatgctaagaaggaatgactagagtggaaaagggagagccaggactgaaagggattctgacatgcagagaaggtttcaagacatttttctcttcaaaaattatttattggggtgaaatttacataacacaacattaaacacattaaagtgaacaatttattatattcacaatgttgtgtgaccactgcctccatctagtttcagaacatttcagccactccagaataaaatcccttatgctttaagcagtttctccccattctttctggctaccagtccctggaaatcaccaacctgtgttcttctcaatggatttctctcttttggatatttcatataaaaagtcatacaatatgtgaccttttgtgtctggcttcttttagcataatggttttgaggcttatctacattgtagcatgtacttcattcctttttattactgactaatattctgttgtatagataaaccacactttgtttattcatttattagttgtggacatttgggctgtttttgccttttggctattgtgaatagtgctggtatgaacctgcatgtacatgtacttgagtaggtgtttttaattcgttttggctattacagggttatatgtaattttgtttaacttttaaggagctcaagttacttttaaagaggccagcattatctcatgtgccaagaaatcatggactaaagataggcaggtggatttgggtgaaaagtcactgaatccctttgcatgagcagtttagtggaagtggggttggggagggcccctgactgtaatgagtgcattggtgtccagcctctaggcctccacaggagcctccagaaagtattgctttgaacagggtaccacctgctcagaccctccacattttctcaaaccatccaggatttttcctcagcttatcttctcctactaaccactacaaattgcttctcagctgaactactacacgacatgctctctgcatgagaaacgcttagataccttttccttgagctgtttcctctttgcccaacagatcctccttgtccttcaaatcctccctcaaatggcaacatgcagcttccctggaggccttcttccagccaccctgcttcctccttccctgagcctccatttctctttgggaggaccactccttgggacttttcctatttctccttgagggtcaactgtttctggtccaggtcccaggcccctgcatatcactgaagcttttcaaggggattggctgtgactcctacagcttctggccccatgcttcacacacttgagtcctcaggagagcttgcctgtcattgaacttttaggaaacacccacttcctgtgagcttttcagcagggtggtcctcttatgtgttaactttgtttctcctttggttagtagtgtgcttggaaaatggggttatcctatcaagaagctgtaccccaaattctcttgaaactaaaggaagtagctcatttggaacttcctgctgttggccgtcatccagaaccttctagttagacccaatttgtatcaattagtccacagaatattggttgtctgttttctcaaagaaaacctttctgaagtttttcggggatagtggtatttcttcatggcacttttttttttttcctctagttaactaaagctttatgatctaaatggaagttgggtcacccttgtattgtttaagaagggtgtacatcagttacaatgttgactgatgtgggaggttttggtgggtggagcattctctatataatccttaagctttctgaatatacatgaaaatgagttaatctcttcctcttttttccccacccttcctgcctagcttttataaaaaggccttcttccaaagtctcttctccttccccctccctttctgcccttcctgtcttgggatctctgtgtcttaggatgctttttcctgtgtaaggtcacctcttcttcctggtagggcatgtaaacattcatttcttggtttggggcagcattggattctgggaatgatattgtgtacctggcttgttgatttaaaaatttgatttggacaatttttgctctttataagatttggtcatttgttgtattttggtgatttatcttgaaattgttctttgcttgtatgtgaagctcttgcttccttgacttattccaaacagagatggtggcaactgggaactgatagtgattcagcaagtacttgttggtttgatttaatgttttgctgacaaaaaacattaaaaaacagaattttagataaagttttataaaggtgtattcaaatatatttatctaaggcattttaaaaatagaatggtctttcctaagtataaaaataactttatatcatggtatcatgtgcatctgcttctagaatcctagagacccttgttcaagatagagaagaaaatttgtcccttggcatagtgattgcatttgattgtgacatttggtcccaaacagttctgatttcctatcctcagaggaagcctttgacaagttgcctcagtctacggttcctgagatgcagcgtagtaatttggcacctgtcatcctgcagctgaaagcactaggaattgacaatgtcctcaggttccacttcatgtcggtaagtcctgcctgctgtctggggccatagggaggctagggagctcacagggggatgtcaggacattgtcgtagggcatgccatctttcctttttttccctactcaggtcatgtgttgtgtgtctgctttgcaaccaggccctgtgcaggacgtaggggaaaacagccagacaaggtagcctcaattcctattcttacatagttcctgttcttgtctgctggggaatagagacaagtaagtgggtaattacagagcagtgtgcccagggctctgagagacaaaggaagggcctcccaggtgaaacctgaaacccaaatagaatctcaccaggttaggagtggagagttccaggacagctagtctttgtagaggcctagatgcaggagtaccatgattgggggatccttcctgcagctttagatagagctgcaggaagacccttgtgcctgattgcttcctgagatgatttctaggagtagaatgactgggtcaaagggccgttgtcctgtttagggtcctgttacatggccagattgctttaccaatgtcaactctagcagtgcctgaatgcccaccttgtggtacttccattgtgccatgttatcttctttgggtttgctgatttgattggccagagagaggaaatcacctttattataattatttttaaatttttcataagatagatttttataaaaacatttattagtcagtttttatttcttctgagttgttaagctatttatctgttagaatttgtgtcagttagtgattttcaagagtcctttgaatattaaagacattaatttttataatatttcttacaaatattttctatttatattttactgttttttttttaatgtgtggacattctaaacatattcacagtaatctatttttgcctttatgatttctttggctattctttttttctttctttattttctgagacagtctcactctgtagcccaggctggagtgcagtggtgccatcttggctcactgcaacctctgcctcccaggctcaagtgattcttgtgcttcagcctcttgagtggctgggattacaggtgtgtgccaccacgcctggctaattttttatatttttagtagagacaaggttttgccttgttgaccaggctggtctcaaactcctgagcaggtcaggtgatccaccccgtctgggcctcccgaagtgctaggattataggcgtgagccaccacccccggcctctttggttattcttgcccttatgaagtacttcttatatttgggtcagttaatacatattctctcatattttcttctagaatttttatgatttgagaactttgttttttcccaactgtatatgatatgacaagtctggaaagtctggattcttggatagtaaagtccctaatgtcatatgtgatggtaaactaggtgaatgaaagaatagaacatacaaatatcaactcccccaaagaaaattgtgtacttaccataagtatagggaaaatggaccctttgattattggtgtagagtagaagatattataaagaaaagataaacaggctgagcgtggtggcttatgcctgtaatcccagcactttgggaggccgaggcaggtggatcacttgaggtccggacttcaagaccagcctggccaacatggtgaaaccccgtctctactaaaaatacaaaaattagccaggcatggtggcatgcgcctgtagtcccagctacttgggaggcttgaggcaggagaaacgcttgaacccgggaggtggaggttgcagtgagctgagattgtgccactgcactccagcctgggcaatagggtgagactctttcttaaaaaaaaagaaaagataaacagtatgtgctgatttgaaagcttatgaaaagccccgcatgtaaaattaaagaaaaacatacagtgacagaaatgacagatcagtatctcaaaaaatatgaagagtttttatatgcacatcatttacagtaaatattcactaaataaagctaaaggaaaaaaacagcacaaattcaaatttcaactatcattaggacatgttgagcttctctaggagagaggtgactgcacgttgatatagctataaaggatgactttacactaattttttttttttttgagacagagtctctctctgtcacccaggctggagtgcagttgtgcgatctcagctcattgcaacctctgcctcttgggttcaagtgattctcgtatctcagcctcccaagtagctgggactacaggaaagagccaccatgctcggttaattttttgtatttttagtagagacggggttttgccatgttggccaggatggtcttgaacgcctgacctcaggtgatctgcccaccttggcctcccaaagtgctgggattacaggtgtgagccactgtgcgcagttgactttacactaattaaatgattgagtataaacaaaaatggtgaaatcgaaaactgccacaatttgggaaagtaaattcctcccatgttataccgtttctgtccccatggaggactttctgacaacatttaatgagccgtagaaatgtctgctatttcttctcataaaaatttctcctgaaaaaataattcagaagaagaaaaaaagcttacatatgtgataatgcttatagcatttatattacatttaaaaatataaataatgaaaattatcgtaaaacttttggacagttgaaaaatgaaaaaaaaaatacaaatttatcttcacatatttccttctggttattatcccctgaaattgtggtttttatgattgaaattacagagtacatataattttgtatatttagcaatgttatttacaatggtgaaaaactggaacaatttaattgcccagcaataagaaaattgacttttttatggagtatgattgtcatagagtattatgcagccatcccaagtagttactgtgaagtttgtatgggtgcaagaaacaatgaaaacagaaaaacatgtagtgagaagaccacactaaaactatacataaacagtaattccagatatgttaaaacagtgtttctgtattatcccaaatcagttgaggtcacagagaaatactagtgaatgtgattagatgaaaatactatggataagatttttgtggagagggggataagttttttttgttaattgactggaaatcgggccaggaattgagtcagagctgaccttgttagctttttctgtaattgttaaaagcctagttcagagattgctattcctgttacctcatccactctcagtataaaagatcccacagggtttaagctccttcatttaagtgttgcccattttgcttctttgtagagaaagatgttgtaagcaccaaggaagggctagtggatcatttacatgatttgctcaatggtgatttgttgaatcctctctgtgtaatgaatccaataggtttagttcctgccctcgtgtgttcacctgtgtgtacggtcactacaacttttaaaaaagtttaactttggtctttggcaaacaaagtagggaaggtagactgggaaaaatgaggcctgagttcagctttgccaccaactgcctatatgaccttgttcagctgtcttttccttattgcagttcagtttcctcatctgtaaaactgagctaaaacaatgtgatgaataaaatacatttgttatgtgaatgcatttagaaaaaaatgctatgtgaatttagaaaaaatgcatttagaaaacatcctatgcagtttaaaaatgtactgtaattttattacctgggttattagaaaccacataatttagagagaaaaaatatgatgcctggcacttaggtgctcagtcaagatttgtagaaggaaaggaggtaaagatctggaaaatcagactgaggctcactacatcagctttgcttatgaactttaaggtctctagagctattattttttgaaattcagattcgacatatgttgtagtttccagacagggattaagaaaaaacaaattcagcgtatgttatttacccaccacggggcctggagtgggtctatgggggatgcaaagataaatcatccccgagccctgagtgctgcagtgtcctggggccccggtgtggtagaaggttgagtctgtgaagtaaaaattagaaatgtctcaggagggtttaaggaaaatgaagaggtagtttaagatagggacctatcacgtctgatggaggggaggatgagggagcacttcaaagggaaatgtttcatcaagctgagccttaaaggccaagcagtacaagggtgcctagaaggacaggaaggacatttcaagaggtgccaacagcaagaacagaaacatggaggctgggaagaatggggcatgttagaggggagaatggatttgaaaaggaaacagccacattttaatgtttgttgcccaaataaattgattcaggaagatttttatgttttttccagccccctccagcacagtcgatggttcaagccttggagttactgtatgctctgggaggtatgccagtttctctcatcattctctcttattatgtgttgtcttttgtgatattagtgaggtcatattcactttagggattttagtatcttcaggaatgggattggttctccccatatatataatccccctaatgatactttattgaaataggaagttgggaccataattagacacatgaaagctaattatgacagccagtatataaaacatgccagttcgtcagaagctattagtaagaatcaccagggctacactcctaagagatgtctagagatcagcagttccctaccaggatgtcagatcttacctccccagaccttttttctccacccaacaaccacatccttaaaaatcgtggctcagtattctctccctaaatcctcttcatttcattcctggagttgcttgtggagaattggggacattatcagcttctaacaccatgttacgggggaacttctattcagttgtcgattgaagatgttattaggttggtgcaaaaataattgtggtttttgccattgaaagtaatggcaaaacccgcaattgcttttgtcccaaccttaatagcgtttatcttgacatagagaaaatcatagtctgaattcaccgctttggggagtactgtttcttctgtgattggtaccacaaatgaatataatttccaattttgaattaagttttagtggagattttgctttttgagatttattttgagtgttactttttttttaagtagctgtattgaagtatagtttatgtactatacaattcactcgtttacagtgtacaaattcagaggcttttagcatattttcagggttgtgcaaccatcaccacagtctaattgtagagcatattcatcacccaaaaaagaaatctttacccattagcgccgaacttctcattctctttccccctagtcccccagcccaaggcaaccactctctggttcagtctctatagagagtttttatctctataggtgtgccttttctggacatttcatgtaaatggaattgtataatatgtggtcttttgtgattggcttctgtttcagtctgtctgctgttgctataacagaatgccagaggctgggtaatttctaaagaggtttatttgggtcacgattcaggtggctgaaagctccaagattaggcagctgtatttgaggagggcctcagcctgcttccactcaaggtggaaagcaaaaggagagtgggcgggtgcagagatcacatggcaagagaggaagccaggaagagaaacagaggaagccaggctcttttaagaacctgctgtcatgggaactaatccattactcaccctgggtaagggcattaatctgttcatgagggatcaccctcatgacccatacacttcccagtaggccccatctcccaacactgtcacgttggggatcaaatttcaacatgagctttggtggggacaaactacatccaaaccatagcagcttctttcatttagtatcatgtttcacaggttccttcatgttgtaacgtatattcataccttatccccttttatcactgaataatattctgttgtatggatataccacatattttttatccattcattagttgatagacatttgggttgtttccactttttggctgatataaataatgctgctataaatattagcatataaatgtggttttggtggacattcccaccagcaatgtatgagagttccagtttttccacattgttgccaatgcttgtaattgtcttttgtgttatagccatcctagtgggtgtgaaatggtatctcttggttttgatttgcgtttccctgatgagtcatgatgttgagcaccttttcgtgtgcttgctgcccatttgtaaatcttctttggagaaaagtctgttcaaatcctttgcccatttttatgtgtgctgttgtctttttttttttttttttttaaattgagttgaagttcttcatacattctgggcacatattcttatcagatatgtggtttgtaaatatttctcccatttttgtgttttggctttttacttacatgtacttactttttacttattagtattgtttgcagtacaaaaattttaagtttttgtgtggttccatttatctgtatttttcttttgttacgtgtgcccttggtgtcatgtctaagaaacttgcctaacttgtagtcattaagatattctcctaggttttatagttttggcccttacattaggtctgatccattttaagttacttttttggtatggagtgaggtaggggtccatcttcattcattatgttgattttacttctctgtgaatagccaattactgatttaaaagatctccagtgatttaaaagaccttcagctggatttacataagatcagcctggagtgaatgtgtgttggagaaggtttccacccccttcttctcaagcatgtaatgggaactcgaaagcacatttcctgggctgatctgtagtgaggatgagagaatgttgacagcataggagtttttatttgggctggtttttctccagtcaaacagaatgaaatttaagatatttcctatttcttcaataccctaaataagctggaaaagatagagggaccccccgcctccccccgccagcttcatttgatttcaagctgaattaccacctttaaagagatgtcttactgagctctgccttactgtgagatcttgcagcgtttaagtagtaaaacagtagtctatatcttgggaatccaatacctggatattggcaaggtattgccaatagagggcaagaagggcaggtggggagttgaaagagtcagcccagttcagcaaaatgttcaggaggcagttgcatgaacagggctggtgttggcaccagagggatctgggttagtgtttagattccaagttgctggccctgtagttgctcattgttgttctcattgtggctaataaagagatactcaagaccgggtaatttataaaggaaaggtttaatggactcacagttccacatggctggggaggcctcacagtcatggaagagcaaaggcatgtcttatatggcagcaggcaagagaacttgtgcaggggaactcccatttacaaagctatcagatcttgtgagacttattatcacgataacagtatgggggagactgcccctgtgattcagttacctccactcggccccgcccttgacatgtttacaattcaaggtgagatttgggtgggaacacagccaaaccatatcactcatttagtatgagaagggcacaggacacgggatgccatcgataccatcctggcacatctgtggcctgtccggtcctggaggtggtagaaagtccagacagtgagggggcaatggagatggcagagaaccaggagagttgggggccgggagctggcgaagagtagttccaagaagcagcggccagcagagccgagtgctgctgaggccatcaggaagatgccttgcgtttggtgctacccagttgttaggttcttgggaagagtggtctcttcggagtagtgggaacaggtgaggctcttgtggattgaggagagggtacaagcaggagaaggctgcagggggatttccttataattaagtccttgaatagaagtctttagaagtatcagttttttaaaaaattgggtattcaagagctcagtggagatcttttcttcttttaaggtaatggcactctagtgtcaaatggagtttggtgtagtgcatgaatcatcttttggatactttcttctttttagcatacattatcttttattctctcagcaactgtgtgccttccaacacaatggtacctgccttctgatttcttttgttgttcttatggcaggtctggacaaagactgtcgcctaactgaaccgcttggcatgagaattgcagagtttcctttgaatcccatgtttgccaaaatgctgcttgaatcaggtgggtagagcctgatagcttgaattgattttattttgactgtcagaggtgttgtttgcctgaattctgagcaccctggggaagagggtacaatatggtaaagaagtatatatatatctgtaacataacatttattgttttaaccattttatgtgtgtagttctgtgatacaaagtacgttcacattgttgtgcaaccatcagcaccatccatttctagaactttttccatcttttccattgaaactccatacttggtaaacacaaattccttattctctcctctgccccgcccctggcaaccaccactactttctgtctctatgaatttgactgctctgagaaccctcagaagtgcaatcacacagtatttgtccttgtgactctcttgtttctgttagcataatgtcttccaggttcatccatgttgtagtatgtgttaaaattttcttcatttttaaggcggaatagtattttattgtatatctataccatgttttgtttgtttatctgttgacagacactttggttgcttctaacttttggctattgtgaataatgctgctatgaacatggatacacaaatatcattttgagtccctgcttttatgtttattgggtatatagccagaagtggaattactaaatcatgataattctttaatttttaaaaatgtatttttaattgacaaataataattgtatatatttatgagatagagtgtgatgttttaatctatgtacacattgtagattcagtcaagcaaattaacatattcaccaactcaccaacttatcattttttttgtgctaagaatttgtgctaagaatgttaaaattctattctcttagcaattttgaaatatacgatacattattattaactgtggtcaccatgcagtgcaatagatcactaaaacctattcctccagtctaactgaaactttgtaccctttgatcaacacctcctctttctccattcaccccctgacccaggggatctcccagcctctggtaaccacctttctactctctgtttctatgagattgacttttttagattccatatatgagtgagatcatatggtgtttgtctttctgtgcctgccttatttcacttggcataatgtcctccagttccatttatgctgtcatgaatgacagtgttctcttcttttttaaggctgcatgttatttcattgtgtgtgtacatatttatataaaccacattttctttcttcattcatccagtgaatggacacttggattgcttccaaattgtggctgttgtaaataatgctgaaatgaatatgggaatgcagatatctccttgaaataccagtttcagttcctttgcatatatacctagaagtgtgattgtcagagcatataagtccatttttagttttttgaggtagtgccctactattttccattaataggtgtaccattttgcatttctgccagcagtacacgagggttccaatttctttgacttcttcagatttttgtgaggacatgggttctaggttaaaagatctggaagtcttctcgtaattagaaatcaaagtcatctagaaagtataatttgtttttttacctctgggaaagacagtttaattttttcttggttttgtctaacttttatgtcaactagcaatttatgaagatgtactttagacccagtatggggaaagctaactaattatgttttggaacaaccacttgttctcagccttccatttagaaacaggattcttttttttttttttttttttgagacagtgtctcactctgtcgcctagactagagtgcagtggcgcaatctcagctcactacaacctctgcctcctgggttcagttcaagcaattcttgtgcctcagcctcctgagtagctgggattacaggcatgtgccaccatgcccagctaattttgtatttttagtagagatggggtttcactatgttggccaggctggttttgaactcctgacctcaggtcatctgcccgccttggcctcccaaagtgctgggattacaggtgtgagctaccacacctggccgagaaacaggattctaagtgtggactggggaagtgcatcattcatgagatgggaggtagtggggagatgggacgagcagtgtagtgtactctgccttgtgccctggagtggtgattgctggtgactgtttccaggcgttccagcagcccccagcgtgctttgctggtctagttgtgccttgggcttcccagctgagatgaacccttttgagaaggaagccacttcatagaaggggtcaggagcagagaaacagcagaaggggcacaagccgctcattccctgtcccctctcggacttcctgccaggattccagatgttcccacaggagggtagggagcaggtgcggagctgacctgcccttagtgatggggccagtcttgaccttggcttatagtcagagtcccctatatttcagctgcagagggcagtaacacctccttttttggagtccttcaaggctactattcatctgggttacatatgggacttcacatttggctgagtgaaatatttttattttataaacttcatttttttgtttttatttttctgagagagggtcttgtgctgtcaccctggctggaatgcagtggcgtgaacttggctcactgcagccttgacctcccagctttaagcaatcctcctgagtagctggaccacaggcacataccaccatgcctggctaattgtttaattttttgtagagatggggttttgccatgctgcccaggcttatatactatacactttaaaaattaagctctagaaaaaatatgatcttagtcttcagtgtggtgcaaggaaagtatcagaaaatgtctttcacttcttgttggcacattatatggttgaaaccaaacatgctttttgttttacaggaaacttcggctgttctcaggaaattctaagcatcgctgccatgatgcagatccagaatatctttgtggtccccccaaaccagaagtctcacgcagtaagtcagctctgtccccaggctgtctgtaccagtctcttttgctttgagctttcgttgtcaaaactgtactcaggaactgctgaagacagagctgtacaaatgtgatctgctcatgttttgagtgtttattccgtgcttgatgttgtgtcaggtgttttgcaggcatcattccactttatcttcattataagcctgggaagtagatattattatcatattttatttatttatttatttattgagaggaagtctcgctctgttgctcaggctggaatgcagtggcgtgatctcagcccactgcaactgcactctgcctcccaggttcaagtgatgctcctgcctcccatgtagctaggattacaagcgtgctccaccacgcccggctaatttttgtatttttagtagagatggggtttcaccatattggccaggccggtctcgaactcctgacctcaggtgatccgcccttgacctcccaaagtgctggtattacaagcgtgagccaccgtgcccggcctattatcatattttaaagatggaggcatagagaggttaggtaactcattcacagttgcacagccagaattgttggctctggattcacagtccagagccccacaccttaaccattgaactaccaacttctagtttctgtcagggaaattgtcattcagactgctctgctagaaaccttggtgggcacattagtgacataagaagtcaggtgccagggtatagcaggctgattctgggcaccacacgacatcatggtcatgttgcaggtgggccattataagctagagagatccaatccccacctaaggtgcaggcatcagcaatgactaattgagtgaacactggaaagacggaaggacaagttttgatactgaagagatagatactcagaagtaaggtgtgttgatagaggtaggtcagagatgagttcaaagtcagttcctgtttgaaagtcagagaattagcagccttatgcatggaggggctgaatttgtatgtgtaatgaggaggagagagactttcttagggattgttgggatcctccttgtcagttgtataactatagattacaaagtttttctgcctctgtgcccagatgcttatgtctgtttttgtttagttttgtttttaattaacctggaggaggagagagacaagaacactaacattttatcaaatttctttgccagataccttgtaataaattatcttaatccacagcaatcttgataggtttagtttcctgattttacagataaggaaatcaaggctgagagaggttaagtaaccaagctgagttctttcaagatatggcagagctagaatgctgcaaactaggtctttctgaatccataacccacacgctattcaccatgcaatattacttccagtgcaaaagtcaatttctttctttctttctttttttcttttttgagacagggtctcgccctgttgccttggttggagcgcagtggtgcaaacatggctcctgggctcaagcgatccttccacctcagcctagtagctggggcttagaggcatacaccaccatgccctgctgatttttttttttagcttttgtagacatggggtttacctatgttgcccaggctggtctcgaacttctgggttcaggcaatcctcccaccttagcctcaccaaatgctgggattataggtgtgagccaccacacccagcaaagagtgaaattctgaatgttgcttcattctttccagattcgagtgcaccgtaaatttgctgtggaggagggcgaccacctcactatgctcaatatatatgaagcatttatcaaagtaagcacaactactgctcgaagtgccgcctcaacacaccaccctctggaggtgatctaggagggaggatcccagaagttcagttcgtaaaggaatgtccaagagagcccttgattttcctgttagatttattgccagtacttctaactggtgggtcgggctttctgcctgagtttgtggtgaggtattgctgagaagaacacaggaatcattcattgctttcccttgcttggagatatggtacactagtggcaggccagtggcccagcctcacgtcatctcacatccactgtgcagtagacagaaaggcaacatttgaataggaagttctgttacattttctgccaggtgaatgaggctgagagcaacttgtagtcctgggttgaatcttcaaagctgtcccagctgccatgagaagacatttagttgagatctgtgcatattcacatatcccacccatatttagctataagtgatgttaattttttattgttaatattctttaaaactaagcaaataatacagcttaaagttctcatgaaaaattgttaataaaggtgatgaaaatgatgaaaaaagtaaccttacataaaagaaagggtataatacttcagatttttaatactcatttcttaaatactcttttagaagtgaagaaatactaaatttttgtttaccagtgatttgaggaagattattcagttggtgaaaagttttcagaaaaaagaaattcactctttttgagacttacggcttaaatcagttaaaattcatttgtacaggcacaatgtatcatctgcagtctgaagctttctctaccactagaaagtgggtataggtctacattgtattattctatggttgccttcttggaatatcttctattaattacattttcttttttaaagcactttaacttacaatagaatttcagaggtacatttccacagcaataatttactctaagacataatgatcatacttatgaatgcagaaaaaattaaatactgttgatagaaaaatcatgctttggggacaaataatagtaatttgtaaattatttctacattggcaagtgtcatattgttggcttctagtataataaagtgatacattcaagcatgccaaagaagaaaagttgatttacaaagaaccacgtggagaaatggttctttctgatagttcacatctcatgaaggtatgtaagattgaaaccgtttctgcgtgtcattaagttctcatttgccctttagtgtaaagagtgaggttgcagagcagtcagatgtgtgcaaggttgttaacatctgttttgagagatggggcaaaaaagggccagttcccatctttagatcttatgccgttgaacagcacatgggggaagagagaagaatgatctttacaacatagccttagtcgagaacatatctgttttctaactccctctctctgggttgttctgtagcacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgagaagaaaccgtcccagctggtgacctcccttgcttcattctgttgagttgtcttcctaaagttctcatgctgggctggtgcgaggcagtgtggcgtgctctgtaccaacactgggttttatattttgagttgcctgcatctgtgaaaagctgaaggtcaagttgcgtattttttccaaggaggtctatttttctttctgatgggcattcttactaaaggaatttcatagcccatgacaatacttaagaatcactaacagtcacatcagtgcacatcatgtcattgattttcccatgtaggctttgcaagaaaaattactttttgatcagtgatattagtagctattacataaaaattaaattttatattcaaagacaagtattattaaagcaagtgctggatatttagcctaggcagccactaaaggtaagacagaaaagtactatgtaagacgtagtctctggcctctagcagtgacagtgactactattaatcagggacacagtaggttacgctgtggcaggggttctccaaatattctcttgctcaatctcgcactctgtgaggtgtcggtaatgttatcctcattttacaattagtcgtaagatcctagggagaaggtagattaaattcaggaccacgcaactggtaaggaggagagccagatctgtatgtggctcagaagtctacgcttttaaggaagtgacacacccgcctcagcagtcagcctgaaagcctagtgtgccaggtactcagccacatcctcagcaccattagtacttggtaacatttcctgagtgcttataagtggctagacagtgcactgagtgttccatgtgtttattaatttaatgctcacaacaacgctgtgaaacgtgtgctcttttccccatcttataggtgagaaaagcgtggctaagaggtaaaatgtaacttgctgaagttacacagtgagggtatgatggagtcagaacctgagcccaggcggttccatttaagtcttcttttgtctttatactaagagcaagtgattaaacaatgacggagtcttggcttttactctaagggaacagtgtaatgaagggagagattcatatggatagacaaagtactaagattatcagtcctcttcgaagttaaagtagtagatactttagtaatcatagaagacgtgctggcagatgtggaaggaatgccgggaagaaggaatccagagagggctagcttgggaagtctttcagcttccttgaggtgtggtgggagtccggtcaagctttggggtctggttgaattagaaaatggtggcaaagagcactctagggaaggaggactggagacaagtgcttggagtgaggagtatatgagacgctcagagaatatttgatgggtgaatacactcacgagagagggaagagttgaaacctgggccattgagccatgttggagtcattgatagaaacaggatgcttacaaggagcacctagttggagagcagctcgtcaaacgcctgtcacccagcaggtagatgacagccttacttcagcaattggtgttcttcacctgtgtttcattatcagacccctgcccaggagaaaagttaaatttaaattctacccagcctgagaaattaaatactaaggaataagattttgtagggtaggattgagctttggagggctaccggccattgtagtgtctaagatgctcccctccccctgcctccaagaaccagtttccacccctttggaagtgatatcacccctgtttagagtgcatattttacatggaaatttcttatggacaataggagagaagagactggatatcggattagatcatatttagacatgtagatttgagattttatcagctcagtgcttaggaaaaatacagaaaatcatggagactaaataaattacatgcaaatttaaaacatctaagggttaaaaaatagaaagcaattagtgaaagatactttcagcagtcatgagataaatgataaagattaaaaactttattatagaatgattttatttaatatatttaggaaaaaacagttttcaggttgataaatgggctaaggattagaacaaaaaattcacaaaagaagaaatatgccgatagtaatcaaataaatgtaatataaaagaaggtaacagaaggtaacactttttgccaaaacattgctagtaagaatgcagtgaaactgccatttttatatattgttgatggctttggaaatagtaccacctttatggaacttacttaccaacatgctttattccattggatctaagataccatcatgtgtaagaaacatcgttattttatgtgtcaccaaagaaaaaaaatgctgccagttatcattgtaaaatgctgtcctaatttcagtgaattaaagttagaaaaagagcgagtcttaaaattgatgagatgtgatatgtcattaaccataaaaataacattagccttttgcacaacaatttggaatgtatcctatggacatcatctaatagtggggaagctttattcatggaagatgttagctgtagcaatagaaacaccagttaaaatggaacatttgaaaaatttgaagaattacttcaattttcaaacactagctcataaccacagaagtaacgttgtatactatctccagtttgtgttttatagaaagaacattgttgccatatgacactcttttacaaaggagttctgaggtcactgaccagcctgcagagcagcactcttaggttctggtgcccagccatggtccagtcatctgtggcttaggggaggttggaggggtcccaggttcaaggagcagaccagcattgttgtcagcagcagttgtggggagtgggacctccttagatggtgctggggcaggcatccagcattgggaagggtagggctggagccatttcaggagagggtttccaggtgtcttgaagcagcctggggtggtgctgggagtggatcctgtgcattagagcacacggagcctagggcaggcaagggtttcacccgcctctctgttggctgcctatgtaggtgacccggatctggttctgaggtgcattgtctccggcttcttcgccaatgcagcgaggtttcattctactggagcttataggtaacatgatacttggtgaagtcatttgttaaaggaacaatcttacaaatgacccaaaccccacagaaagctgtgcagagatagtaattgcataattatttgtaatttctaccatgtctccttccaaaactgagttgaggttagcgacatagctttaagcaaaatatcttgactttctaaaaatgattctcacatattcagctcatctatatgttgtatgttttagaaggatgacaattatacatcttgaggctggtaatatttcaattctaatgacagaataatatgacctgaagaaactattaaaaataatgtttctcagagaagttattttacaattggctagtttattatgtctttagagatctgcacgactgaagtcccctcccaccctggtatagtgtggccacgtctggtgtctttggaggtagccaggtgtttctcatgtgctggatgtgcctcctgctacataacctgattcttccagttccattttctaggcataggaaatcactcattgatgccttcctaatggtctttactatattcaaatgcagtgaaaactaagcatagcttaggcatactgtagcctgtcagtatcatgattctccaaactaatcattccagtgctttgaattgttacttttattctgtcttttctgtctttggctcattttagtttcataacctcagtgtagcctcctaaaagtgtagctatcatcattttctgttctttaataagagaacactccaaagaatttctccccagctcttctatgtattattttgtcattaattttttttcccagagaaaatattactgccctgttatcttgaggtcagccaagatatcccttgtcctgggctcctgttaatgagtccagagttgcactgagccttttttaattttgacagccagatctgctccatctagtatcctagtagccgactgttggaactgcaggatagcactttacaatgatctctagtatgttctctttgttactccaggcatgttgtagcctgtcagtattgtgattcatttgcccattgtatgagctcacctccccaccctgagttgtctgtatttgaggcaacttgtccatgtggaggcgacccccacggtggcccgagatcttccctaaggagtgctgccagcttgtcatcttgattgctcctactctcctggagagttagcaattttgactagcgtttggaaaattcttttatcagtgtccttagcaacaatgtgggctacctaagaggttccaggctaatcattcctttgagacaacatttagtgttgatcagctcaccaccccctggtaggacagcccaggaccccaggacgctggctttattacaatgccgacgaggcattccgtcacagcacttgaagcacttcccccaagaaacagatcattctactgagttggaattggaagtactatttcagagaaattaatagtccagtattgagcttttttttttttttttgagatggagtttcgctcttgttgcccatgctagagtgcaatggggtgatcttggctcatcgcaacctttgcctcccagtttcaagcgattctcctgcctcagcctccggagtagctgggattacaggcatgtgacaccacacccaactaattttgtatttttagtagagacagggtttctccatgttggccaggctggtcttgaactcccgacctcaagtgatctgctcgccttggcctcccaaagtgctgggattacaggcatgagccaccatgcctggctgtgagctttcttttttcattatcgttacgtccccctatagtcattatctttagtatttaactttgctttttagattatagaagaaatcacatgtattatttccattccaaaggaaattgttttgaaagagcacctgcagaagatacacataaacataggcagagcattttattcctaaatgttttttctaagtgtccgcgtgttgcttttctcctcttcgctttttccacgtgatttattcttgacttctggggtggcagccaggagagggatcaagaaaggttgcaagagaagatggagataattgttttgcttgtgacgagttcagtctgcatgcttttttggtaatattaaaaatatctgtgggaaagtcttgctataagtatttaaaatgtgcttcagacaaaattcttctatgttccaaggaccatccgtgatgaccatgagctgcacatacaccctgcgtcagtcctctatgcagagaagccgcctcgctggtaagctcatcctgctgcttagcctgtgcctgctttgaacagggccatgttcttgtttttctcctgtacatgtttcttgacatcgcctctagaattgctgctctgggccgggcgtggtggctcacgcctgtaatcccagcactttgggaggccaatgtaggcaggtcacctgaggtcaggagttcaagaccagcctggccaacatggtgaaacctcatctctactaaaaatacaaaaattagccaggcgtgatgggcacgtctgtaatctgagctactcgggaggctgaggcaggagaattgcttgaacctgggaggcagaggttgcagtgagctgagatcacaccactgcactctagcctgggtgacagagtgagattccatgtcaaaaaaaaaaaagagaatttctgctctggcaaagagcttcttaagcaaacagtgatatttgtctactcactcatccactcagcaaacgttcattttcaaccactgactggatgcttagccctgcatgaggcacagctatgcagagatgaattgggatcccagctcacggttcttttttttttttttttttgagacagagtttcgctctgtcgcccaggctggagtgcagtgacggcgctatcttggctcactgcaacctctgcctcccaggtccacgtgattctcctgcctcagccacctgagtagctgagactatagatgtgtgcaatcacgcctggctaatttttgtatttttagtggagatggggtttcactgtgttggccaggctggtctccaactcctgacctcaggtgatccacccacctcggcctcccaaagctctgggattacaggcatgagccactgtacccggccccagcccacagttttgacatagggacagacacagagtcaactaccttaggggaagggctttactagcagcatggatgaagtgctgggctcagcacatcatgtgccagtgagagtcagggcaggcttcatggaggagataacattcattctgaacctggaaacaagagtgttcagtcagaaaggacccggagggtattctaggtagagaagtagcaggggcagagccatggaacataaaggaacctcatgcgtttgggaagtggggaatcattggtatgggtggcccatgcaatggtgctgctctgtaacactgcctaggaagaaagaggtaagcacagaagtctagagtaggcctttagacatctttataacatttcaatggttaagtttatgtttgtccaatttaataataaaaattgggggcttatatttttcttgtttacaatttcatttttctagaattcatttatattgtattttaccaataaaaagtactgattaaaagtactgatcaaccatggattggattttgtttttttgagacagtgtctcactctgtgtttttgagacagtgtctcaatctgttgcccagtggtgtgatcttggctcacttcaatctccaccttcggggttcaagtgattctcctgcctcagcctcctgagtagctgggattacaggtgcatgcaaccatgcccagctaatttttgtatttttagtagagacggggttttgccgtgttggccaggctggtctcaaactcctgacctcaggtgatctgcccacctcagcctcccaaagtgctgggattacaggcgtgagccactgtgcctggcccagattggaaattttaaagacgacaacaacttgtccttctccaattggaagatggagaagccctgggaaaaagggtggggtgtgtgtgaagagagggagagaagatagcggtagatttgaaggcaagaaagtctgtggtcaaacactttgtaccctagaattgcagctttcaaaatgtggtctccagcccagcatcagtatcacctggaaacttgtacgaaatgcagcttctcaggccatgccaagtcccattcaatcagaaactggactagggcctaggactccattttaacaagccctccagatgtttcttttgggcagtaaagtttgagttctgtttccctagaccaaggaatcggatttatcctgtagccactgcagacctagaagttgcttaggttgaaagcaccttggtcggttctgggtttagaaatgttacccagtgaccacactaatgtggtcaggatacgcacactcgtgtgcaggataatttgaagagtgcccacgcctgtcatctcagcacttttgagaggctgaggccagaggattgcttgaggtcaggagttcaataccagcctgggtgccatagccagacctcaactctcaaaaaaaaaatgagccaggcatggtggcacgtggctgtagtactagctactcaggagactgagacaggaggatcgcttgagcccaggagattcaggcttcagtgagccatgattgcaccactgcactctagcctgggtgacagagcgagaccctgcctttaaaaaatttttttttttaaatcaagagagatgcaaaacctcaattttagatcctttttttgctgacttttgggtggttaaatttgggagttgcttaaaggagaaaggcttttctttttcttgcttcattcctaaggagctctgaagggcaaagaaaggttggggaaatagagccagcctgaagccatgccataccattcaggtggcaaagaaagtgccccccagtcacggcctctttgcagggggggcccttctttttcctttgatcagctgagattcacttactggtttttgaggggtggggaaccacagtatggctggtatgtttataacatgggaagccctgaattaacactttggatgtttcagaaactgatatctactcatatgcacacctaaaatcaggggactggatgttatgctcttggctcttcggttgtctattacctgagccttagaaacattttttcccttaaataaaggtataatttatttacagtgcaagatgagttttgacaaatgtgtatacccatgtaacctggacccacataaattatacaatattgttatcattttagaaaattcctttgtgtctctttacagtcagttcccagcctctttcagaatcaggcaagtctttgcctccatttctgcattttctaataaagtcattaggctcagttcagagttctgtaaatgcagatgaaggatccagaaaggtccttcgcggataactgagatgttccagaagtcattgaggatttagagtctcatctgaaaaatggacacaccattacccagcacttaggtcttgaggctgtggtgagcaacataaatgcatgtgtttagcacagtgtctggcacatagagtagaacctgttaaaggttaaaggaaacagcatgtctacctgtggttcctgactgtcatcacaagagggggaaattagctcatgtttctttctcatttcagggtcatctataacgaagttatacagacctccaagtactacatgagagatgtgactgccattgaatcggcctggctgttggagctggctccacacttttatcaacaaggaacggtaggaatgaactgagtctgtgccccagccacctgttcacagcctctccatgtttttaaatgtactttttttctccaatttaatgccctatgtgtgttccccctaggggtgcatagggtggaaaggccattaccatatccccaaaacattctgggaaagcactctagcgtttaattcatagtgaagtgcaattaaaaataaatccccctaatctcataagaaaaaaaaggtatcgctttctcgctttctttctccttttgctcttccaaactatttttttttttttttttgagacagtctcactctgccgcccaggctggagtgcagtggcacgatcatggctcactgcaagctccgtttcccggattcaagcaattctcctgccttagcccccatgtagctgggattacaggtgtgtgccaccacgtctggctcatttttttctttttcttttttcttttttttttttttgtatttttaatagagacaacggtttcaccatgttggccaggctggttacaaactcctggcctcaagtgatccacccacctcagcctcccaaagtgctgggattacaggtatgagccagcaggcctggcctgagctaattaaaaaaaatttttttagggatggggtttcactatgttgcccaggctagtctcgaataactgggctcaagtggtgctcctgccttggtctcccaaattgctgggattacaggtgtgagccaccatgccaccagttcgttttttatttttatttatttatttttgggacagagtcttgccctgtcatcctggctggaatgcagtggcacaatctcagctcactgcaacctctgcttcccaggttcaagtgatactcctgcctcagcctctctaatagctgggattacaggcgtgcgccaccatgcccggctaatttttgtatttttagtagagacagggttttgccatattggccaggctggtcttgaactcctgacctctggtgatccgcccgccttggtctcccaaagtgttgggattacaggtgtgagccaccacgcccagctccttttttaaaagggttacagccctgtgctgtttgtggcctgaaaatacttgctttacatattttgcccaagtttactgttgtttacagcagaagagaaagtctgaaacctttttctccattagggccagaattggactacacaatgtttccaaagcgatatttgaattgattgccacattgaaaaattgggagatttcatattaaacatgaatttctggtttctcttgaaagacatgtttagtctggcaacactaggcttgcgttcctacgtggtggcatcacaggggcttaggggtggctgcctgctgttagtgacatcgccaggtgccgtagtcccatgtcacttgcttacttgcctgctgcactcttggagacatttgaatttgtgaccctgtaaatggaaggatctcctcatctctcctgctccagcaaagtcaagggacattgccctctcaaaattttataatatttaatttttatgtaatcaaacaaaaaccatttcacacctttatagttcttcacacatcccaattcagatatttcagctggaaagcagatcagcctgcagggactgataaaaatgcagtgtgtgttgtctttgctgaattaggttgataagaataaacctggtgaaagaaaggcttttccttcaaaacctctcaggtggaaagcagcagacttcaggagtcaagagaagggatcagaaaggtaaactagaggttgaaagaggaatggtgcagtggtcaaaatgcctgttaaagtaagaagatgcagacagccagagaaggataagcctgaaattgtcttggattcatttagactcttggaaacagaattagcccagaagctgagtcattttcccttctcagctcaaaattccagtttctttaggtcaaacccacaaagttaaagagcaaatagcttcagaaatttgaagaaaataacaagcccaaatttcttcatttgtctcttctctccaaatggcttttttatttttaagctcatcacctccactgtcatcggagtatttttagagaggctgggacagacctttagaaatcacctagtgcggccgagcacggtggctcacgcctgtaatcccagcactttgggaggctgaggtgggtggaacacatgaggacaggagttcgagaccagcctggccaacatggtgaaaccccgtctctactaaaaatacaaaaattagccgggcatggtggcatgtgcctgtaatcccagctacttgggaggctgaggcaggagaatcacttgaacctaggaggtggaggctgcagtgagccgagatcacaccactgcactccagcctaggcgacagagcaagactgtccccccaaaaaaaaaaaaaaaaaaaaaaaaaagaaatcacctaatacaacaacctcattgtataacgatggtccccaaaccacagagaaacttgtgttgtttcttaactgtatagtccaagggcacttctactattaacttgtccaaagcagattgatttctcaaagaacctccagatctacaggggttgcccatgtatggtagatgttcctttactgaacacagtgcagcacctcacaaccttccacagcccacagatcattcacggctctgttcctggcacctttggagactttccatcaccactgtttttcggaatgttgctctcaccctgtgtggaggcctgaaatggttcagagtcagctttgtttatattcaacattcttcccagaaaaaagcaccaaaaatggccccacaggcacaatggcgtcatctcccatccccaagctaaggccgtggatatctaacattagctgtaggggttatatcaggtgacgtgtagagagagaattcagagaaattcagcaagacctacagctagacaggggaagaacggggtgacctattcagagatttgccttctggcttttaaattatttttccttattctcagagatatcttcattattagggaaaacccttttaacgaggcctttgcaagagcctgtagtagtcctccctcaggtgtaagcagatggaaagtctgagttcttgtagctcatttatacccgggtcctgttcgctctgttgtctctcacgtcatacctggtggtgcgctgtgtcttcgttcacgccctccattttttcagggcctgcagttctctctgggggcgatgcggcttgatgttgtggggccatgtggctgtgctaagtagtgggcacaccagctccggagcagtcagggtgggcattctcatgtgaggctcccactgtgtgttagttggcacggcttagggatctcttggttattgatgattagtaatgggctgtcgggtatatcccagttgatgagtggagggaggtctttcattaaaagcttgtatttacacactctgcctcaaaggcatatttaaggatttctgccacttttggctttgctttagaatgtaaaaaatacttcattttccaatcctattatctgatgcctatgattagaatattgtgcttcgtgttattcataatggtagaaagtgacatttctggggaaaaaaaaaagtgtcactaggaggtgtcctttctgttttcccagcaagcttgtaccctccatgtgggcagaggccatatctttatctccatccttgagcatgggtacctggtgtgttgagacgcttggtaaattgacttccttggtcctaaagagaggataatttttcttgactattgtcaggaacttcttggagatttgagatcacttccagactgagcccagtctcctgagcacagttgtctggctgcggtgctgtcctctaggctggggcagagggagagtcgtgtctcaaaaagaaaacctttccttgacagcttccgcagagccctgtataaccagcttcagccgctgtggcttgggcctcgggttgctggcggctgaattcaggtcggcttcttcattggccacttgggctttttccttccaggctgtttcatgaacagctcagcatttactgggaaggtgtggaccagatggaagatttgatgtggtcattcatatggggattatgttgcagtctggtttctttgtctaatcaaccccaactgtagtgtcttctcttctgttgcagcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccacacctggttttcgtgtctgtatgttaagatgttctaatgaattgttcgaagtgagggcctgacattagctaagaaacttaatgctgtggcatacagcagctttgggatctcagggacacaggaagccccctaaagcaagatgatgtgactgaatgacctcaagacctgattagagtaaactgtgggacatttaaaagaagtcccaaagaggtgctaattcttgccagtttccagttgggatcttcctgtagagaggtcagaaacattatttttcaagtttggctttaggactggggctgatcctaaaaagcttatatggcggtggaaggggaaaggtacaggtttcacaccctcgggttggagaccagagtccactgggagcccggacaatctggagggagcacccagaggcaagcccgtccctgcatgctgcctctacccctgggcgcctgatcctgagcacatgcttcccctctgtccctccacctctcagaaggcagccctccccaggcgacaccccccagtgttgtgtcctgtgttatgtcacagtctgtgatgggtgggacaggtccttgctgtccgaagcaactacaaaatcctgggcccatggggaggcccctttacagtagggttggttaaggctgggaccacacaactcaccagggagtggggcccggcctgggcgagagagatgagagcttttgactttgtctgttgcaggtctgtgtccctgttcccattgtcagcccacagatgtgacagcagggcctagtacctcacagactgtcccccagtacttccacagaattagtcccctcgggctccacacaggtcttcagatactgctagtaaaattccccacagcattgctgtgtcttccctttggagcaagtgagagggcagagagaagctggcgctggaaagcatggaggcggtggtgccctgtaggcccagagatggcagctttctgtgttggtggcttgcagagaccctgccagttttctgccatagctggcttccccgggggttggacattgtcgtcacagggagcccctggttcagccagtgcgctgctcagtccagccagcaaatgttgagccctcaggccatgtgcatggcacagggatgaggcggagacacttgacaacaagtaaccagatgagtggaccaggatggagctgggcgcacgagaaggacagggtggcaggagatggcagaggtccagtaggggttgttaaggccagggctgtatccacagagacttccccacgacaagatgctttcctggtgaaaggacagaccgctctcatgttcttccctggccatccccacattgctgagcatttcatgtgggccatgaacttggagagctgcctagtgccccagctccatgctcccatctccactgttttgtcctggtgtcagcacagcctactgccagtgctgctccagcttcatgggctgggccctgccattcagtgctgggttgtccccagcaccccagccctgccctcagctctgttttccagggcccggcgctgacagtgtggctgacatttctcctagcctgagcaagaatgtctgccgctgaccagacagagggttgggtggctgggggagggaggcgcaggccaaggggcctaaatctggaaaaccgcaagactccgtcctggagccacaagactggatgtctggcagtgaggcctgggaagctgtaagttgtaaaagccccatctcgggtggttctgatgaagtggtgggcttgggaatcctggggacaggagttgaagatgtgaagacatgcagcccaatggacagatagcccccagcggggagatcagagcttcgagatcagagcgtcaggtctgagtgaaagctgataaattgtttcttcacaagtgtgcttagaccccagcccaattccccttacgtgtttccccagaacacagatctgtggggttgggattcttccccaggcaggttgtggcagcaggcatcaatgtcagctcactatgaattttcctgagtcttgcaaaaatgaggaatgtgtagtaatgagcattttataaagcttaagtttattctctataaaagaccatcctttagtgttttttattttttatttttattttttgagtcagagtcttgctctgtcacccaggctagagtgcagtggcatgatctcggctcactgcaacctccgcttcccgggttcaagcgattctcctgcctcagtctcccaagtagctgggattacaggcacctgccaccacacccagctaatttttgtattttcagtggagacagggtttcattgtgttggccaggctggtctcaaactcctgacctcaagtgatctgcctgctttggcctcccaaagtgctgggattacaggcatgagccaccttgcccggccatcctttagtcttttcttggtgctaagatgcttttaggaaacaatggtgatagtagatggtggttttattttttaatgttttctttggaaaaataaaatgtcaacagtcgttcatctatcacccaattaaaaaccaattcaaaatgatgaaacaaaaactgatgtaatcctcaagtctgggaactactgggttgtggctgagtgggccgggcagggcatctggcagcatcagcaccaagatcatcattctgggaagtggatctgaactgccaagcacccacctgggtttcaagtgaactttggcgccgctggaggacatttctatcccctggaagaattcgagttggcaagtctcagccccatatccctttttcacctcaagataagatcaggtattttccactctccaatgattcatctgaattttctcctcagccttctaatttgtgatgaaacaggatgatggaactctggatttcttgtcagtttaatctgtttttttttttctttttttctgagtcattggaactggaaatagccaatcaaataattgcacaaacagctggctactgtggatgaccaggtggaatttgcgtggcagacggtctggagagggcttgtccctgggtcctcacagtcattgctccctccagcaagcaaggatgacacgttgacgtctctggtgaatcctggcagtgttcccttttgcactcttgggtggcattggacttgctggaacagggcgtctccttgcctgcttaagtgcggccaaagagattcccagcgcagcgttcccccaggccctctggcacacatggccaccgctcccacttgtgggttctcctgaaggcaatgagcaggctagggaggctgggaggttcacaagggaggggtggtgcaggcacaggatttaataccccaggatctccatagccaggtgaacgaccagcacaggctactgcccatggcttcttgaccatggcctcatcagtggctccaagtatgaacgtcctagccaggttctttgctggcctcagcctgatgggcggacccatataggacccaaaggtcgcctgagttcctttctgcgtccccaccactgccatcagcctctacatcgccctggaccccaggagagcaggagctggctgataaggccttaccagctcaccctcaggctgtttattttagcctcgttctctggttgcttttcttccccgcattttaggcttgttctgttttcaagtgcggtcttcagtttgcttggtgtctgctgtccctgtgttttccctttgctgttgtttttttgtttttcctcatgggtatgcctcacccctttaatctccacctctctgacctctgcattattttcctttttactgcgaagttttaaaaagaatgcagtcgtgtttatttttaatgctcttcaaaagtattttttcctcgacatttatgttaacgtcttggtcttttttgtactctgcttgtttgtctaactattattttggacatttgttgtcgtggttctataaatattttcttctgtgatcttcttttgtttctttttgttttgttttgatacagagtctcgctctgtcacccaggctggagtgcagtggtgcaatatgggctcactgctgcctcggcctcctgggctcaagtgatcctcccatctcagcctccccggtagctagtaaagacggggtttcttaatgttgcacaggctggtctcgaactcctgagctctagtgatccacctacctcggcctcccaaagtgctgggattacaggtgtgagccactgtgtctggccttttctgtgattttcatcttctactttagtgtattagtttaaaactcaacagttgacttcccattttattttacttcctttgccccccttctcttcatttctttttttttttttttttttgagacagagtctcgctctgttgcccaggctggagtgcagtggcatgatctgggctcactgcaagctccgcctcccgggttcacgccattctcctgcctcagcctcctgagtagctgggactacaggcacccgccaccgtgcctgcctaatgttttgtattttttagtagagatggggtttcaccgtggtcttgatctcctgacctcgtgatccgcccgccttggcctcccaaagtgctgggattacaggcgtgagccaccgcacccggcctcttcatttcttattatgcttaatttgctttagtggttggcaaaaggcctacctgtaggtgtgggagctgggggaaggtattccaaacaaaggattaaatgtcaggaatgtacaaggagctcctataaatcaccagtgaaaagacaactccagcagaaaaaaatgggcacagggaatggaaggcaatgtataggggcagacccaacactccaccaaaccactgaagagatattcaaagttagtcatcaggaaaacacaagctaaagcaacaattagacatcactctgcaccaatgagattagcaacacagtggaaaggtggcggatggagatgcggcggcctctgtgcgcagctggtacggcagtcctggagagccacctgggactactcatgtgtgttcctgccccacagcccagaaactctgcttctgggggtgtgttcccaacaaaattctcacccgggtccttaggagacacatgtaaggatgcttactggtgtgatggatggggtggggactaatgtccatccctgggaggtgtgcagggacaatgtattggatgacactgtggatcagtacagagcaggttcatagaacacagacctgagaaatagctgagtggaagaattaagaaactgctgtaatcccagcactttgggaggccgaggtgggcaaatcacaaggtcaagagattgagaccatcctggccaacatggtgaaaccctgtctctactaaaagtacaaaaactagctggatgtggtggtgtgcacctgtagtcccagctacgcgggaggctgaggcaggagaatcacttgaacctgggaggctgaggttgcagtgagccaagatcgtgccactgcactccagcctggcgacagggcgagagtctgtctcaaaaaaaaaaaaaaaaaaagaaagaaaaaaaaaaagaaactgatgtgatagtcctgttcacggagactaaaactacatgcacacaaaaccaatacgattgcaaaaatatgtacaaacaagatgtgcatcgcaagtgttgcctgtgggggtgggggtaggacacaaggattggcaataaaataaaatgtaaaatgaagtaagatggggataaggagcctcaagtgttcatctggaggagatgtggattttaggacacatagcccttcttgtctaaggttttagacctgctcaccagtggccccgggaggcaggaggttgtggagttggcttcagaagcctgcctcccacctccaagctcatattctggcaggaaccacttctaccctggatggagtgagtcggccaacaacatgagacattttgatgctttttttccctatcacagcgcatttttactcagatacatgatctccttgggacacccttttaactcgtgtttattctacatgccccatggtacagttaattttcatcggcaatctgaaagccagcaacagccgcagagcttgtctaatcaccaaggagtcaaagacatgcagccccgcggcccctttcagtagaggtgaaggaactcactggaaaagccctccccagtttatgattaaataggctactaaaatggagggtagcttataggatttatctgggcagagcgccttcatacttccagggcaggaaccagtaggacagacagtgtcatttaagtccttcctgctgatcagtatccttaggttggaatttatgctctcagcccatagggactcttgttccctccacttcggcacttggcactctgcttctgagcctttggccttcaggaggcgaaagagaactggatacaccaaggctttgaagatcctgatgagcttttgccatccgaggagcatgtagacttgagctgtgtttgctacacccagatgtggctccctcctctctcttgggcttactgatcatttagaaccagtttaattagcactggtgtctgcttttccaaagattgcctggtaggaggcagaaatctgggccaggttagtgaggcagcatgcaaactggaagagaccaccagggaacttgtacaatgtaagtcttactccaagctttccattgcttggagaagggtgttctaaatcacccttggtcttcccgacttcagttgcagactcagaaggagggcagattctggggcgatttcttgacccagtggtgatggggtcgtgggaactcagcttctagggagacagggtaggtttcctgtccccagattaataaaccaaggtcacttctcctgaactgtgatgatgcctggccctgttcttagtgggcatagatggagttaactttttttttttttttttttttttagaggcggggtttcactatgttacccaggctgatctcgaactcctggactcaagcgatcttcccatctcagcctcccaaagtgctgggattataggcatgagagttagatttttcacatgggatttttgccaattgattagtctgttgccccagccaggattaggacaaaagggctttgcatccccacagcctctcttgattgatcttgttcatgcacagatggaattcggacaccctttgggtatgtgaataacccttacaggccacaggacccagattagtgacaccacaactgggcatcatctgagtagggaggacaggagcactgagctccaagtcagaagatccgaattaaaaaatgaccacctttaatgaggtataattcacatgtaataagtgcactcatttaattggatagtcaatacgttttgacaaatcagtacaccacagtgaccaccaaaatcaaatatagaacattttcacccaaaaagtttctcatgatcttttgtagtcaacagccaccccgactttgccccccagcctcaggcatcactattctgctttctgtcactatgggctaactttgccttttctagaatttcatacacatgggatcatttaggatatactcttttgggtctggaggagacctggtttaagccccacacccaaaattagataactttgtgacccttggcaagacataattttgtcttcaactcagtttccttaccagtgcaatggggtggtaataacttaaaaccagcaagccttccttccttccttccctctccctccctccctccctcctgtccttccatgtgcacaggtgccacagtgagctccattgtaaaattccagaaaggagctgggtcaggggttgctcaggaaacaggagcctctgctccctccacgtgtgtcacagagggcacccgctgcccctccctccatgcccatcccagcctccctggtgccgtggtgtgcaggtccccgcatctccttcaaggtggactccttttatttaaacaagggagataggaagtcaccccggaaagaaccagatgcggtgatgagggcccccaccctcaagatgggcagaggccagaggtgaccaggacctaagcagaggggaggaccatgtcagggggtgggggtgcacagaggcccggagtggggcccgcctggccctggggctcgggacactggagttttcagggggagcagtgagtggaaggctcgtggagctgctggacaccagatgagtgttggcatcaggacacacacattgctcagaaccacccaggaacaatctgatggacacctttgtgcccttcacaacacaactcactgacactggacacccagaagcacttgcagataagagaccactgcacacagagcacagtccctgcttccctggagctcacgtgctaaaacatgacccacatccaggctgcagcccgtccttagccagggatgtggagggtcctgagtctggtcctgttgagtcctgagtcctccagactggccctgccaagttgccaggcatctgatgcagcagagcagcgctatgctgccctctgctggccacatggaggcagtgagtccccacactgctgtccactcctggcaatgggctcaggggaagtggactgtgtttctggtcccttgcttctgacaacctgatagagcagatatggaagggcagaggcactataagaactcttctcccagttccttgattcccccccattattccttgtgtgtcccccacttcccctcccttccctgtgtctggatttaagaaatgacagttgaggcaaatcatgttgctttttcggccatctcctgcagtgtcccctttccatggcctcatcctgtcatggccctgagctgttgcaactggttcagggaggtctctcttggccatctttcatccagtggggatggagagaccagtgccatttctggagggagcacctgagtttggaggtgaaacataggtgataccttatccaggtgacaccttccctaggccacaaaaccatagtttctagatggagctgggcatggtggctcatgcctataatcctagcactttggaaggctgaggctagaggatggcttgaggccaggagtttgagaccagcctgggcaacataggccctgtctatacaaaaaaataacaatttaaaaaattagccgagtgtggtatgtgtgcctccagccctagctactcatgaggttgaggcggaaaagtcacttgagcccaggagtttgaggctgcagtgagctgtgatcagttgtaccactgcatgtcagcctggtcaacacagcgagaccttgtctaaaaaaaaaaaaaataaaaatagatggactggtgccgtgcctttttttttccccccacagattctttgacatgcctcccatgcagaggtggggtctatgtccctctcatgaatctggccaagttggtagtggttttgacccagggttgtgtgaagtgatgtggtgtgacttctgaggctgggtcacgaaaggccatgcagctcctgcctggcttgctgggacactgccacccgagcaagccagctacctgataaccaggatgctggagaggctactcatgggctgtggttcatgatgccatctgagaagtgggtcctctggcccagctcttccagggcccagccttctgggtcactgtcagctgaggcccagacatgcaggagtacagacaagctgtccctcctgtgccctgtcccaattcctgacctggcttctggagcttggtttggagatggagcccaccttgacaatgctgtttccctgggagaatgggccccctcttggctggcttgcaggagctctgggagtctccttcccctgtgactcctaggggcttggtggctctgagctgggcagctccacattctctcaatttcattctgtctgatccatgttagttttatttactttttatgtattttttatttttctgacatagaatctcgatctgttgcccaggctggagtgcagtggggatcatggctcactgtaaccttcaactcctgggcccaagggatcgtccagcctctgcctcccagaatccatgttcgttttaatatgaaagcaacgttttatgcgacaaccaggagctctgaagggttttcacgtggatgagccacacgccgggatttggaattgcgggaagtgcccagcgagtagggtaggaggaatgttgggggtgggactggactagaagggaggctgggacgtcgtcgagaacgagattgcagggacgctgcggtgggagaagtcgaattcccaccctgttcgtcctccgcaaagagtgactgaggctcaaaaagccacagccttgcccaaaacggatgcagcgggcgcaggcacggtccacaccccgaagcttgccgatgccctcggcggcagcccgtcctgcagagccgcgttccctgcgcccaaagcaaggtcggacccccaccgggattcccggaaccgggtgtcccgcgcgtccccagcgcaggcagagacggcgagacttccgggtcggcgttgcacacggcggccggcaggcggcgctggagccccgcgtttgggcagccaggacgcccttgcgctgcttcgggtcctgcgagcgcccagggagggggtgagtgcggggaggggtcagacccgtgtcttgcccggtgcgagctcaccgcctgcccaccgggcacgtccacagcagctcagtcccggtctgagcgcatcggagtgaaaacagcccccgcacctctcgtgacggtgtccccttctctgtccacgttgcaagaagctatactgtactcaccaagtctttaaatcttgaccacttcaccaaggaaggtatgaacctctccattttacaggcccagttcaaaaagcaacgacaaaaatcaacaccagcaaacctttatggagttctaattattgacctggcctgccagggtccttcagagtggagttggggtgggtgcgggagaggggtcaaaagccagccctcaggagggggccacccgcgcagccctctctccaccatcagggctcttgcagacccaagggcctgccaggagaagcagatgggccatggtaaatctgaggggccattgggatgcccagactgtcccaggtcaccccatttctgcatttttgttcattttgttcaggtggccctgaatgttgtgccctcctcttgggaactgtaagtaatacaatcttcctttcaggcagttgactctgtgtctgtcatcttcccatacctgattacaacaaaatcatcccatgtacatttttaaacaactgtctaagattgtcgcagggctcaaatgacttaactttaagtgcttacaatgatgcctgacacatggtaaggctaatcgaggagtagctattgttacatctctttctccagcctcttccttctttgcaccaactgcctccctctgagcaattttgagggaggtttatctcgaggtgcagccaatcccagctgctagggccaagatcagccacgtgctcctttcccttggccatggctttggacactccaagctggcagtgagtgccaggtgagggggctgctaggagccggcaggggggatctcacctttgtgccacttatgtccctaatcaggggcaacctccccaaatctgcacccccaaatcccctccccagcttgactggagaaatcactctaactcccaatgatagcaactccaaatcatagcaataataatttactgagtgcttacagtgagccagacacagtgctagcatcttgtaccagcagttctcaaactttttggcttcaggaaccctttacaccctaagaatgatcaaggccctcaaagctcttgttcatgtgggttgtatctatcactaattaccattttaggagtcaaaacaaattttaataatatttatttataatttatttaaaatagcaataataaacactacatgtgagcataaataatatattcctatgacaaataactatatttcacaacacacaaaatttaaagagaaggaagtgtggctttgttttatatttttgcagatctctataatgtcagccttaatagaagacagtttgatttttatatctgcatctgcaagtttttgagataccacatgtcatgtagcccctgtaatattccactgggagttttaaaaagctttcactgagagcaaaaaacccccacaaataacatgtttgtattattgtcaacattattctgaattttatggaccatctgaaagggtctcagagaccccagaggtgcccataatacactgtggaaactgctgcctgatatacatgatgggtagcttccaatattgccccatttttacatatgaggaaactgaggcacaaggagattaaagtgacttgtccaaggtcatgcagccaggcatcaaagctagctggggagtcacttgattttggtgtccagggtcccagcactgagccctgaaagagagggtaggaactgggcacagaaaaagccggaagggcaggttgggccatgagtgggggagctgggtgtgcagtgaggggtgggggtgggaggggaccgggggatcagttagtcaccaagtggtcctggtgacagggctggagatggcagctggcggcggatgtagcctcgggctggaaaatcaataggtgatcagcggtccaggggcaagctgttcatcaggtgcggcagaggggcaggggcaggggcgggggggctgggaggaaatatcactgacccccggcaggattgatcaaacagccagacacccaaggccaaactcactaataaagtgagacattcagctcagcccggcggctgctgctgaaggtcttaaaaaaaccgcttactggggagttcttgataaactgtctttgtttcttgaggcaagtgggagggaggacagactgtggggaggcctggctcggctgccgtttggcctgggactcatggtttgccccaggtctggaccacagaaccctggtgcttgtatggcatgtgtgcttgcactacagcacatgccatttgtacagggcatgtgcagacacatatgtgcacactatgtcgcacacattcaaatgtgcctgcacatgtctttgcacgcccgtgcacatgctacaacctacatttgcttatggtatgtgtgcacacatatgcatgtgctacagcacatgtgtacaaatatgccttgcatgtgtgcatagacatgcgtgcaccgcatcacatggcatttacacatgcatatgctatggcacatatgtgggcacaaatgtgccttgcatgtgtgcgtatacgtgcatgtgccgtagcacacagaatctgcctttgaggggtgagcatgtgtgcttgggggttaaactctttctccattgtttcactgatatcaccactttctctgcctgtagtcccaaaggtgccacatttgtaatgacagtcatgattattatggggtggggagatggacggaaaagtagggactggaaaactgtatctaaaaggctaagctgtacaacagagagaggcaggtgtgaacaggaagaaagagggggaggaaaagtgaagggccggcatggtaagggctaaacatcgtttggactgggagttgagggagagaaaatggcaggattcgggggtggctgggtagctgttgggggagcaaattaaagaataaaggatatgcaaatataatttttatttttattgatttattttttttaagacagagtctcattctgttccccaggctggagtgcagtggcgtgatctcagctcactgcaacctccacctcctgggttcaagcagttttcctgtctcagcctccagggtggctgggactacagtctcatgcagccacgcccggctaatttttatatttttagtagagacagggtttcaccatattgctcaggctggtctcgaactcctttcctcagatgatctacccacctcggcctcccaaagtgctggaattacaggcatgagccatcgtgcccggctgcaaatagaattttaagaactgtgttgggtaatgacatcctttgacattctttcaggaatccaagtaaagagtagaacctttcccgatcactttctgattgttggactgtgttttgttaaatgtgctaccgtattagactgggcttgtgcatacacagaatttattttgatttaataattacatcactcacattgagaatgaaattttattggaatgcttttgcagatgagaggttttattaagagcttttccatgtgtcatatactaactcgaaggtatggatactacttttatttccattttttggatgaattcattggagctcagaggcttaatcacttgcttaagtcaggtggcttataggaggtggaactgggatttgaacccagccctctgactccagagcccaggctgccttggccattattccagagtatagtggggaatctggggggtcagacaggtagaccaatggaggaacatttgccatccctgtatcttgccccaagataggtgagtagagccctgaggagaggggcagtgcatttggcttgcacaccattcagacccttcacccaccagcagttacagcccatctagccccaagatccctcccccaagatcccctggctgggaatcatctgctctcttgattgctgaagggtgcatggatgcattggaaggggctgggaggatataccaggctctgactttatggtgtgtagaccttaaacccccaaagcctttttggttttataaaagcacagaacaaagtcattgagaatgatcaaggatcgaaaccatgggagaaatataaaactatattttcttaaaatgtggtcattgaaacacctgcattggaatcactggagatatataaaaatggaaattcctgggtgcctcccagatctactgaaccagaatctctgagtctaggggccaagggatctgcatttaaaaaaatgtcttgagtaattcttctgcacattctaatctgatcctttgtatttgctgttccctccacctggcatgctctccctgtagctctctctttggctcccactttcaatcctttagatctctgttcaaatatcctttcctcagaggggtctttcctgctatcttacctaaaataataccccttgcattctcaatactcttgctctgctttattatgttattatttttagctacatggatgctaactatatgtaaataaataatatatagtgtacaatatagataacaatacatgataaagccatttaatccatatcagccttatcaatgtgcttatttgcaccttttggtctgctccctgagaggcgaagctctcggagggcagggctggcctgccttgcttagggttgcaccctcagtgaactgtattgggtctaggagaggttgatatgggggaggggatgatgcatgcagagtgcccaaggcttagtgggtgctcaacataatgactgtatcctaagcgtggtgtatactatgaaaacaaaaagccataagcttccttgttctggtagtaattccctacccctccaccctaaggaccagtgaaactgttatgagagtgaccaagaagaaacgtcttctcttgtcctcttcaatgtctgaattctgcatccagcacattatcttcggtgtctcccccatttacttccctcgccttcttccttaaggaatatcagcaatgataatcccagcgactggccaggcacggtggctcatgcctgtcatccccgcactttgggaattgaggcgggaggatcacttgagctcagaagtttgaagctgcagtgagctatgatcgtgttgctgtgctccagcctggatgacagagcgagaccctgtctcaacaaaaaacaaaaaaactcagaaactataggtactggtagacatgctaatttcacatcttaagtagactccttaactctttctgttgcactggctctcagtcaattttggggaaatctctctgggaggggaactctcaggtccaaggctggcaaaggaccaattgagttcctcttctggaggactgggtgacacagacactcaggtcactgtgtttgccctgaaggtggatggcagatgggctccaaagatgctggggtacagatcccctctgcctttggtaagaggctggggaggtctggccctggtggagcccccaggctgggacctttggaccagagcagcttcatttgtgtacccagtgaatcttacggattttatcacattctctgtgtgccataatgtgaagaacgttgggaagcattggtgtaggtgcaggggtgaaggcagttgcattgggccatgaggccatctgtgctttgtttgctggtcttggaccagcctctgtttgtgagtatgagcttgtctgggcctctgtttcttcaatcagtagcactgtaaccaggacactacagcagatatagcccaggaaggggccaagggtcttgaaagggcagaggcagtggagtggggacgatacagggagtctgaactgggaagggccttgctaagaagaatgtgaagcctaaggtgagacaagagattattcgagagcttggagcattgatatatgagttgggtatgattgtccctatgtttcagacaaggaaaccaaggctcagagtagtggaaaagctcaccacagtcaacggcagaactaagtgggcctgagtgctttcttttcttaatgctgccccttgtagctcaaggaaatttgatgaagagtgttttgaaacttcagctggctcttgacaagtgtttgtgtgacattttggtgggagagatggagatatgtctgctggtatttgggacaattgggtacatcgcatcagtaccagtgggaatagagcagccttgacatttcaccatctgaggaatggcaggaggactgagaccattctgtcggaagaatagaaaacttagagggtgcgttgagttgaataatttgccccaaaagatatgtccactgagaacttgtgaatgtagcctttttttttttttttttttttgaaaaaggaatggccaagcacagtggctcaaacctgtaatcccagcactttgggaggccaaggcaggcagatatcctgaggtcaggagtttgagaccagcctggccaacatggtgaaaccctgtctctactaaaaatacaaaaattagccaggtttagtggtacatgcttgtaatcccagctacttgggagactgaggcaggagaattgcttgaatctgggaggtggaggttgcagtgagctgagattgtgccactgcactccagcctgggcggcagggtgaaactctgtctcaaaaaaaagaaaaaaaaaaaaagaaaagaaaaaagaacaagaaaaaaaaagataaaaggagttcttgcagatgcagttaaactaaggatcttaagatgagatcatttgggattatctgggtaagccctaaatgcagaagaggaaaagacatagacagaggagaagctgctgtggagacagaggcagagactggagaggtgcagctgcaagccggaaatgccaaagactgcgggcggctgcaggagctcagagacaggcatgggacaggttctctctcggaccctccaggaggaaccaatccggccaacacctctattttggactgccctccttctcagaactgtgtgagaaggagaaatgtctgttgtttgacatcaccaagcttgtggccatttggtacggcagccctggggaactcatactggggggtaggatgccgtcctcaaagaaatgagggttgtcatgtggaagagggaccctactcactctgtgtccctggaggaatgtgagctttcctctgagcttctaggtccttaggaaaagggctccgtacagtcagggggttcagggatggagtgggctgcactggggaggtgtgagtaccccattactgatatgccaccagggagtttcaactggcatctgttgtgtagttgaacttgaccatttgtgaggccccctccagccctgagaatctatgcactggtgcaaagaaagaggtaaatgtttagagaggtgacagaggacctagagctaatgtccaggatgctgcccaggggccttagagatggtgacaatggttggtggggatatgggtctgttggagaggaggaagaagaggaagagagcctgactgccaggcaggcaggggtatctttggggctctgggagccccagcctctggattctgccctcagtgagctttgcaggacaccctaccataccccctccctgctttcttctgatagagtcgtttccatttggatattgccttgaacatgatgttcacaatccccaaagggaagaacatccctcaataagccacacaattctcccagccaagaacttgctgttccaaattcattaaaattgctgtgatattctcttcccatttatgtgccaagagccgttgtggacagaattcataataccatggagtggtggatgaaaccgattgtgcagtcagaaagaagtgaacttattttattttatttttaataaaagtgtacctttcaggttggcaacaaatgcgagtgtgggtgtggggaaatggcacactgatgtgtttattaagggagcacaaattggtccaaccccaatggatatcaacttggaaatgatataagatgcaaaatgtgcatggtagttttgagttttttagtctctaaaattcaggtgggcggccgggcgcgatggctcacgcctgtaatcccagcactttgggaggccaaggtgggcggatcacctgaggtcaggagttcgagaccagcctggccaatatggtgaaaccctgtctctaccaaaaaaaaaaaaaaattagctggatatggtgacacagttgtagtcccagctgctcaggaggctgaggcaggagaatcgcttgaacctgagagtcggaggttgcagtgagccaagatggtgccactgcactccaggctgggtgacagagcaagactctgtctcaaaaaaaaaaaaaaaaagtgaaattcaggtgggcaagatatgtcagttttagttagtctgtgattgaatttgttttttgtctcaatacctccctctccctcccttttccaccagaaggtagaaaattaattctaggtaattcaagataaactcgccatttgagggggtcttcagcccattaagatctcttctcttacgttccttcctgggggatttttgctttaccttagtaaagaacctttccttgcttcctggggggcgaggcactgtatttgggggtgcttatgtagtgagtccttgctaggctgtgacccctcactgcaacaatggtgctggtgaaggtgtctgtggaccagcgctgagttatctgcgccatttgctccttactgtgcagcactgagagcctttccggtgtgggtcccagctcacttttctgatcttctcaggtgcacacactcattcagctcttcctccgtgctactttggagctgtgaacatataggggagtcgcctgcggctgcgtatctcccccaccatctctgctagcatggctgaagattgcagatgggagctggctggagcccaggtcacctctactttcagatctccaaactcattcaaggcactatctcccccatcccatactcagcgcctacctgagcagcataccaacccacacggcctttctctggagaccttcatccctagtctgttctcgacctcctccctccagcttagaatgtttcccttgttttgattccctttttgcaggaagaaaagctcactcaacaagcactcttctgcatcttacctcttgaacctcaaagccaggaacatccccactttcctcctctatgctcctccacatcgctccttctgccaggcgggtgcctaaattggagtgagttctgggagaaaaaaaccaatgggggccaggcatggtggctcacacctttaatcccaccactttgggagaccgaggctggtggatcacctgaggtcaggagtttgagaccaacctggccaacatggtgaaaccccatctctactaaaatacaaaaattagctaggcatggtggtgcgcgcctgtaatcccagctactcaggaggttgtggcaggagaatcgcttgaacctgggaggcggaggttgctgtgaaccgagattgtgccactgcactccagcctgggcgacaagagtgaaactccgtcttacaaacaaacaaacaaacaacccaaaaaacaatggggctcatacaacacttgtccttttgtgttcttcttatatgaaatatatagaccagtcaaattcgtggagacagtggaatagaggttaccaaggctggagggagggggaaatggagagttattgcttaacaggtacagggttttgtttggggtgatgtaaaaagtcttggagatggataatggtgatggttgcacagcagcaagcatgtatttaatgtctctgaatgaactgtacatttcatacttaaaacaaccagtgttatgttatatatacattatcataataaaaatagtaaaaaataaataaatgccagcaacagagcagaaaataaaaatcccgcatcacatcagccaatacttgacaacagctttctgactttgacccgttgttccatttaggggtcttgagtctgtggaaaccctggccggggtgtacccagctcgagtgcaggggggcgcgtagcagcagcctggcgtgtcatcgtgagacacgggagacaacctgggtatccatcaatgggggaccaagtgaataaatgatggcggagccacacaatgccgtgctgtgcagtgggatgaagaatgtgccctgctccgtgtatgtgccgacgtggaagatgcccacgatgtattgtgcagggagcagaataatgtgtgtggtagcatcttgtttgtgtaaaaaggcctatatatatggaatgggtatgaatttgctggacatttgaggtaaaggaagtgcgacctccttcttggctccctcccttttttctctctttaccagataaggatttatatttgctttccttacttctttttcctctttccacaactgtgattttctaatctacgtgtctactgtgcctgacagtcattttcatctttttttttttggagggggcccgattctcgctgtgttgcccaggctggagtgcagtggcatgatctctgttcactgcaacctctgcctcctgggttcaagcgattctcctgcctcagcctcccaagtagctgggattacagacggctgccaccatacccagctaatttttgtatttttagtagagacgaggtttcaccaagttggtcaggctggtctcgaactcctgacctcaggtgatccacccacctcggcctcccaaagccctggattacaggcatgagccacagcacccagccttcatctatttttaacatgtaaaaaattttgagagataactaatatacagaaaagtgcataaaacagagatgtctagtttaaacttataaacacccacgtatctaccacccaggcctagacattgaacagtgctaagcacccccatgtgccctccccagttaactccctcaagaggtaactgctcttcatttatagtaacaatcattgcttttaaaaactcattttattacccctgtaatcccagcactttgggaggccgaggtgggcggatcatgaggtcaggaaatcgagaccatccttactaacacggtgaaaccccgtctccactaaaaaatacaaaaattagcctggcgtggtggcaggcgcctatagtcccagctactcgggaggctgaggcaggagaatggcgtgaacccgggaggcagagcttgcagtgagctgagatcgcgccactgcatgtcagcctgggcgacagaacgagactccatctcaaaaaaaaaaaaaaaaaaattcatttcattttgaataaatttagattgatagaagagttgcaaaaataaaccagagaattcctgtatgccctttgtatactcacatacccttcactcgccttcccctaatggaaacatcttacataaccacagcatgtttatcaaaactgagattgacactggtccaacactatttaccgaactacgaacttcatggatgtcgccagtttcccatgaatgttctctttctgttccgggatccactccaggatcccatattggatttagttatcatttctccttagtttcttccatccatgactgtttcttggtctcttcttgtgttttcatgactttggcacttataaagagtgcttgtcagaaatttaagtagaaaagtaagaaaagccaggtagaatccttgcttttctttgtaattttcctctcctaagtatatatccctgaacaacatagttaggtttggcctgttttgaattttatctaagtgaactaatacacgcatattcttttgtgtcttacctttttcatttaacattatgtttttgggggaaccattcatgtttttgtgtgcagctgaagttcatttttcttgctgaatattattccgttgtatggctgtaataataataatgcaatggctataattctggattgtttctaggttttggctattgcaaacaatgctggctgaagcattgtttctttttattttactttaagttctaggatacatgtgctgaacgtgcaggtttgttacataggtatacatgtgccatggtggtttgctgcacctgtcaaactgtcatctaggttttaagccccgcatgcattaggtatttgtcctaagcattcttttttttgagacagggtctcactcttgtcacccaggctggagtgcagtggccccatcttggctcactgtaatccctgcctcccagattcaagtgattctcctagttcagcctcatgagtagctgagactacaggtgggtgtcaacatgcctggctaatttttttgttttgttttgttttgttttcagtagagatggggtttcaccttgttggccaggctggtctcaaactcctgacctcaggggatccgcctgccttggcctcccaaagtgctgagattataggcatgtgccaccacgctcggcagatggccgaagcattcttattacatatctcctgaaatagttgggcccacatttctctaggagaggaaaccaggagataaatatccaggagaggaaactttggctgaagaatttccatgtcttcagctggactagatactgccagactttcttccaaagtggttttaccaatttaaacagccccacctgcagcgtcaagttctcagtgtgccctatcattattttttcccctagtccttagtaacagacatcattattttttgaaatcaaaataaatcagtcaagattctggcaggaaagagatgtacacaaaatgcttataacaatgctagggttctatttaagagcatttaataaagagattatttatacaagagtggccaggatgaaaggaaccaataagaaatgctgagacacccaggcactagggcagcaggaagctgttgctgcctctggggctgaagggacaggagggagaagaggggaaagcggaggtccctgcctgggctgtaagcacacatcagtgtttctcaacccgtccttccttcctttctttctttcctttctttctttctttctctctttctttctctttctttctttctttctttctttctttctttctttctttctttctttctttccttccttccttccttccctctttctttctttctctcttttctttctctctctctctcctttctttctttcttttctttctttctttctttctttctttctttctttctttctttctttctttctttctttctttctctttctctcttctttcttttttgagacggagtctcactctgcagtaaagtggcacgatcttggctcactgcagcctctgcttcccaggttcaagcgattcttgtgcctcagctccagagtagctgggattacaggcacctgccaccacatctggctaatttttgtatttttagtacagatggggtttcaccatgttggctaggctggtcttgaactcctaacctctagtgatccacccacctcagccttccaaagtgctgggattacaggtgtgagccaccatgcccggcctcaacctgtttttcatcatgacaccctgttgcatgttgaattgtgtcaccatccaacatatgttcaagtccaatatctgtgaatgggaccttatttggaaatagggtctttgcagatgtaatcaagttaagatgagatctgtcttagctcaggctgctagagcaaagtatcatagactggtctcgaactcctgacctcaagtgatcctcccgcctcagcttcccaaagtgctaggattacaggcatgagccaccatgcctggccctgtgctgtggctctttggagggtcacaaattattgcaatatataaggttatgtctccccaggaaccagtggtcaccctcttgggggcgtgattgctcttgttgaggctgcaggagccagagggaagagccaaactgaggggaggcagagaagggaccagagaacagacccccttccctgtctttccacccactcctgggtggcctcctgctggctggacttagccaagagccaaggctgagggggttcaggggtgctgccttctgagatcagccccggggagcagggcagggctaagaggggcagagaatgggtgcaggttggggcgcccatgaagaacaactcagttcacagccccagctgctcccagcgtctgccagtccttctgggggctgtccttcctctgctagaaaagtaggagacccccccaaggccaacatggcccagaaaaatgggaggagaggctgattttccatccagatggcctctccaggtgatcctgaaccacatgacctatctgaagctgggcagctgcacttcctctgtgcccagccaggacgaggggctcttcacgaggctctgatgttgtggcagtcaatacaggcctcccccagcaccccatagccctcctgggtgccatggaggagtgcagttcagcatccctggcttgcagctcccccacctccccacctggcctccccaccccctcctctttaacaaggcttggaacccttcccctcccagactcttcaggtctatttcctcagggaatcgaggtttctataaagaaaagcataaaacgagatgaacatcagcatcttagggatgatcacagacagcagagtatgggagattagtttgggttctgggccaggttgcctgggtttggatcctggatttgctactcactggctatggaaccctgggtaggttacctaacctctctgtgcctcagctctctctctgaaaagtggggatatgacaatatctgtcttacagagttattctgagcattaaatgagctaatggatagaaagtgcttagaacagtgccaggcatatagtaagtgctatgtaagagttagatctattattactttgctaggtgtgtctctattttgaatgtgccatagaaagttctagagttggctggccaggcatggtggctgatgcctgtaatcccagcactttgggaggccgaggcaggtggatcacctgaagtcaggagttcgagaccagcctggccaacatggtaaaacactatctctactaaaaatagaaaaaattagccgggcgtggtcgtgtgtgcctatagttccagccactcgggaggctgaggcaggagaatcacttggacttgggaggtggaggttgcagtgagccaagatcatgccattgcactccagcctggagtgccaagagcggaactccgtatcggggggggaaaaaaaaagaaagttctagagatggctaatggtgccacctcacgggagtagagctgggcctacaggagaaaaactttcactttttaaaaatacttactttatgttattgaaaaaaaatttttttgagacagggccttgctctgtgggagtgcagtctcagactggagtgcagtgggggaatcatagctcactgcaacttcaaacgcctaggctcaagcagtcctcctgcctcagcctcccacatagctgggcctatagatatgaaccacctatagacatgagccaccccaccacacccagctaatttttattgatttatttttggtagagacagggtcttgctatgtttcccaggctggccttgaactcttggtctcaagtgatcctcccaccttggcctcccaaagctctgggattacagtcatgagccatagtgtctggccttatttaaaatttttaaaacaagcaattgtaatagtatttaggaataacatatttgctctagaaattttaactttttttttttttgagatggagtctcgctctgtttctcaggctggagtgcagtggcgagatttccgcttactgcaacctctgcctcctgggttcaagcgattctcctgcctcagcctcccaagtagctgggattacaggcacctgccaccacacctggctgatttttgtatttttagtagagacggggtttcaccatgttggtcaggctggtcttgaactcctgacctcaggtgatctgcctatctcggcctcccaaagtgctgggattacaggcgtgagccaccgcacccagcctcagaaattttaactttttaaggtaaaatataagtttttgcaaaaatatgataagctttgcaccatttagtgtggaatataagacatgacagattgtcgtcagtctccctttcactgcatgtgagcttccagagaaaaatttatgggtgttcctgggattggggttggacttgcctaattgcctagattgggagttcggtaaacttctcctgctggacgtggaggaggggctgagccttgggctgcattctctgcacccacctctagtaggcctcccaggaccacccaccgcccagcacctgccctggttgccagggaaacagccctttatcgagtggagccatccccaactcagcccagtgatttgtccttgtctaattattattactctttgcattttccttttggatgagtgatgggggagggtcggggggggtgggagggtgcaggagcagaggagcagtgatttgtggggctggcagcttatctttgagaggaggacatttatctttctggaagcagaaaaccgcccaatggagacaaattcagcagttcccgagtggttctgtttgtggattcacacactgatctggagttaccgacctggaattgcatgtgcacgtgggtttggggtgtgggaatgtgcgcacgtagcaagcagacctctcagagtggctctgtccagagccacagtcctgtgagcgtgtctgtggttattgtgtgctcactgtgtacagctcctaaaatggtatgtgcacacgtctgcatgtgtctgaatgtgtgtgcacactttgactagactaggcaacctaggtgtgcctgcttgcatgcactcatgtgataacatgtggctgtgtgtgcacattgtagacaaagcaaggaaaagctgggtgggtacagattgaatatgtagctatcaaatgtgtttgtcttcatggggctctgtgtgtagggcctgagcacatgtgtagccaacttctgagcaggcctgcatgtgaacattgtacacattgttatgagaaccaaaaaatagaccgtaaaatcagggtgctgacctaagccagagacacctgagatgaaggcatagggtttggatagtatggaagatatgcacactgcacattttagtagctggggtagattgcaaaaacatccccactcatttgtccctgcccgaatccttgccctttcaatgtgactttgcagttcctcctaatagaagataaagtctattcccctaccgtcttgacctggactggacttgaaacttgctttgggcaatagaatgaagtggaagggacaatgagtcagttctgagcctaggcctcaagacagctggcagcttccactagctctcttagaactgtgcccagctgcacatgaacaaggctcagctaggctgctggaggatgagggaccattagagactagggggagaacagccccagttatcctggctgcagccatcctacaccatcttagagccaactgacttgcaaatacatgagagagtccggccaagaccagcagagctgcccttcctaacctttagttgaccacagacacatacgtgagccctgctgactcacagacatgtgagcaattacagttgtttttaagtctcgtgagtattggggtgatttgttatgcagcattattgttgcagtgcataactcattactaactaaatactcagcatacacacagatgatgtacacacacagcaaaagcatataccattgacatacacataggattgttggctctgtgtactaaaagtattagttagttatctgttgctgttacaaattactccaaaatttaggagcttaacacacaaacatttattacctcatagtttctgtgtctcaggaatcagggcatggcttagctgaatgtctttggctcaaggtctttcatgaggttactgtcttattattggggctgcagtctcatctgaagactcaactgagggagtatccacttccattttcactcacaggttgttgtcaggattctgttccttgatggtgattggttggggcagggtctccctcaattccttgccatgtggggttttccacatggcaagcttacaacattgcagagtgagacagagagagagagagacagagagagagagagagagacagagagaagcaatggtttttttgtaaccttattgcagaagtgacatcccatcatttttgccatatttgttagaaaaagtcacgacatccagcccacactcaaggaaaaaggagaggggattacatgaagtgtgaaaggagtggggggatcactggggactgtctcagaggctgcctaccacacagggtgtacaaataaataggctcacattcagctggactagctgtacaagatcagcctttttttcatggcttttgctcagccaaagacactgagtgtcagagaaagtgggttttgcaggttctaaagacccaggtattctattctcttggtcctgtcattggagctaaggctattttgcctagaaaggaagctctctctgctgtgggatgggggaggaacacttcactccagaccttccaaccaggattccagacattcacatcctgaagcttgaggagggacaggaatcctcaggttctcagagaggaggagcctttacttagggtgtggctggaggtggagatgcttgagaccctctagaggggcagatgctgagagctttctcctttttgggcatctgacctggagtaatgtggtctccctgtgggatctgattttccttccaagccctttctcctctgtggtctcagggctgggctgtctatgaacatcgcagacccagcctacacttccccgagatgggcaagcccaacctcttcctccttagagctcacctgccctttccactcccttcccaacctgcaatttcaggtccctttgtcccctccccacacccagagctggatattgatgacctgggaccctgtacactgcagcagcactgggcaatgcgcagctgtgtgtgtgtgtgcacatgtgtgcgtgtgtgtgagggtggtgggactgaggtggggggggtggatttcagtccccatatgaagcctgctgcagatcaaaataggcagatgaagtcaggagtggtggctcacgcctgtaatcccagcacttatggaggcacaggtgggaagatcgcttgagcccagtagttcgagacctgcctgtgcaacacagcaagatcccgtttttgttaaaaaaaaaaaaaaaagaagggtagatgtcctgccctgtgaaccagcctcatgttgaaaccttctgttaggagagtggagggcaatgtgtcctcccagagtctatgtggggctccagcccaaagctgggacccactgccctgcaggtattcacccctctccctgcttagagctgcttactgcactgcccagggggccagactgtccacccccaggacaaacttgggctaagggtgaagtcacgtttcccagctcagagctcttgaactggagagtttttgagccccttgtgtagggtcccagtccctctgctttgaacaaacgtgtgcgtgagggtcttgacatggtccagggagggatgatggagtttggactcggggggaggcggtggggatggagagaagtgtgggtgggtttaagagacatttaagcagtcgggctgacaagctcagaggatgtagatatggcggctgggtgaggagatggtgcaggagggagggggaggaggaagaatgacacacagcatgttttctgtaaagttcactggggataatgagtgcctctggcatttgagtaacaaatacagcagctttagtctcctgtccgggattggctctgaggcactaatgatacctaatgatatctgcatgcagaacttccagaagggcaggtagaaacttagctacaagaggtcgctttctgggaaaagaggcagagtgtattccctgaaggctgtgtttccgtaggaagttggaagttgggcatcctgagactctgcaaggacagtccatgtccacccctcccctccaagcccctacccactcaaggtcatccctcaggactggttcctccgtgccttttctccttacccctaccctttgcttcaatccagccctgtttctgtttttgttctctgagctctggactctgtatttgtcaggactttattgacttgtgtaatgagacacttagagatacatccgctttcaggaagcgctggatccaggagattggccagtggtgtcaggtgtcagctgtgctttgtctttcaatgctcctttccttttcatgttctttgaaaagttttttatgaaaaaatttttttttgacacgaggtctcaccctgtcacccatgctggagtgcagtcatgcgatcatagctcactgaggcctccaactcctgggtttaagggatcctctcacctcagcctaccaagtctctgggattacagactgagccactgctcctggctctgtgttcttgagtctcagtctacacagctgcagcaaccctagattttcactttcatgctgaacaacctcagagcaaagaagacctttattttcaggacagttccagcaaaagcctcaggactgactcactggtatgaaccagtcactggcccagcaggacgtggcaatttgcctggctgggcatgtatgggtgctcactctgagggttggcccagcccagctcaaaccacacagcctgaacgtgggagaggggtggtcctcagaatgaaattggggtactaaaagcagagcaaagaggaatggaggccaggcagagaggacccatggagactgacctcagaccctaccttgtctctgtctccttcctggcatctttgacttccagtattgggaactcactcactcatccaaccccaggtttggctctgacactgctttggtcacctggggtaggaaattttgctctggactcaccaaaccttgttcttttcctaaccactgaagaggaagcagtgtataagggtcctccagagaagcaggaccaataggatgtacatgtacacgtggaaacagattgattctaggggcatgactcctgcgatgatggaggctgacaagtcccaaggtctgcagggtgagttggcaagctggagatcccagagagctggtactggagctcctgcctgaatgctgggagagacccaggaagagctgatgtttccattctaggaagagcgcaggaaaataggtcaatgtcccagttggaaagaggttaggtaggaggaaagattcacttttacagcagggagggtcagccttttttcttctattcagcccttctactgactagtgaggcccacccatattatatgtggtgggggacagtctactttactctgtccatttaaatgttaatctcatccccaaacaccctcacagacacacccagaataatgtttgaacaaatatctgggcactccatggcccactcaagttggcacataaaattaaccatcgcaagcaccaagtaggtcatctctgaccctctctaaggccgggtcagagagctggtcagaggactgggctgagttggaactctgacagggcatcctctctgtgccccgaatgacctttttgcctaccttggagcaggttgtgtatttcatctgcctgtacctcattccaaaatattatcttccttggttaccatcagggcgggggacccaggcgaggtctgttgccaagttccctccataggctccaactctgtcaggacggggtccactctattatctccacactgtcctgtgccccgggaagcctgactcctgggggccggggcttctgggctccaggcggggtgggtcctaggagcccccttgggatcggagaaatgggggagagctgccaggggtcggttcccctgctcctgccacaggtgtgtccctcttccctggaggcggccctccctgcggctcccccggcacaggctcaatgacactgcccttcttcctctcaccctcaggtacagggacatggctgctcctgctggtcctggttccagggggctcccctcccctgttggggctctcgaccgtgcccacacctctgacagtcccctcattttatctctgcagaatcccagcaggctgtgttgagagtagtgttcctgtgggagctacccagggggagcgggggccagctcggccctgagaggctgtgttggggggaccgtcctaccctgtgggcactaccaagtctatctaaggctttgtgtccagagaaggctcagagcagtcaacagggttatcctaagcgaatcctaccctccatcattggtatgatgaatttgggcagttaactgagcctgggtcactttcttttatcgcctctcattcattgtgtgacccatagaaagtcaagtcaggtgagctttctaagcctcaattgcctcatctgtaaaatgggtatactaagacctcccccaaggccactctccatagcttatttcatcctgcacagtggactttgtctttggggagaattaagtttggccccaatttcattcattcatttgttcatacattcagggactgccccctggacttcacagcatgctagaggctgggttggacccctacccttcaggtcagaagcaacttctctcccttctctccctttctccttcataaagattttttttttaaaaagttgactttatcgaggtataatttacataaaatttgtatatttcaggtttatagatcaaccatctttgacaaatgtatacacctgtgtaatctgcaccccgaccaagacatagaccatttccatgagtctggaaagttccctggagttttgttgcagtcacctgccacccacccccctcaccatcaagccacgtctgatccagtttccatcactatctctcagttgaaattttcatttgctttcattttgcctgttgtaccctttccctttcccttccctttctttttttctttttttttgagatggggtattgctctgttgcccaggctggagtgaagtggtgtgatcacagctcactgcagccttgacctcccagactcaagcaaccctcccacgtcagcctccagagtaacagggactacaggtgtgcaccactactggctaatttctaaattttttataaagatgaggtcttgctatgttgcccaggcctgggctcaagtgagcctcccacctcagtctcccaaggtgctgggattatagatatgagccaccacacccagccgtgttttacacaaggagagcacatgtctccttggtaaaacaatattcattttcctataacctatctttttcaaccattgccagtaatggccagataaaatacatgaacacaaacacagacgcgtgcacatacgtgtacctatgtacacacacaatcctctcacatatgcacattcacacttacacacatacatgcattacacaaacttacatatatgcatacaaatataggttaaggaaactttttcaaggctcaaaaagatctaggccatggtgagacagaacacagttgtgtttttactgaaacccctcgtgatagtgcacacatgaacacacatgcacacaagccccaaagctgagaatcatttgccatcacttcctgctcccctgtcagagtcagcgcaagaggagaaaaatcggaattctttccctgtctcaaaagtaaaagggacaaattagtttcttgtcagtgcactgcaataaatacattgtcatttttatcccccagtgaatcatagtctccatttctcccgtaactattatacagtctgctggcactatatcattttttggtaattttattttcaccaattgttttatgaaatttttgagttttatggacactaaaacaaatctagcctgcgagtgttatagccctttaaatcatcggcaggaaatctcaaggttcctccagactgtggtggaaggaggctttagggaagaaagatcgcccctagcttataaactgagcaaaaacccagagataagtttgtaaaagggacatagatcatggcgggtgaaaactggggtgtaaaacatctccctgctcagctcctataagaataaaaatggacttttatttagcagaaacactaaagtagttggggagaaggaacacatggtcctaatctcctctttcttagccacaagagcctgtatttccctgtgggtcagtgtgagcctaactccagcagctcatagccaggagggtaaccaggttagggaccatctcagggaagccaagaatccccgtgatgttggcacaaaacacaaccctctatatgaatgtcaaggtcatatctctgatgtcagtggaaaaagggataaaactgactctaaagcacatgggaaaagaaaaaccaacaatccaatccaacaagaggagaagagctaaattgatgtgaaagaaggtttgccttaccaggtattaaaatgcattataaagctacaataataaaagcagcatgttactggcatacgactagacagacaaatcaatggaatgaaatagtcctaaataaaactcagtccatgaaaaatgaaagatcacatatcaatagaagagggatggattattcagtaagtgctatctgtaaatgtggtaatttggaaaacagtcaatttagatatttatctcattcaagagtccaaaaaataaaaactagacagatgaaacatttgaaactaaaaaattaaacaataaaatgctggaagaaagtattaaaaaagtatttgatttccagatgaggaggcttttatccatgactttgggtagaaccgctaagaaaaaagaccaacagatttagcttgcaatatgtttacatgcctgcatttcaagacatatcccccacctagaggccaaaagaggctgggcatggtggctcatgcctgtaatctcggcactttgggaggccaaggcaggaggattgcttgagcccaggagtctaatatcagcctgggcaatgtggcaagactctgtctctacaaaaaataataagaaaaaattagccggacatggtggcataagcttgtgattctagctgggagggtaaggtaggaggatcgcttgaacctaggagattgaggctgcagtgggccgtgtttgcaccactgcactccatcctgggcaacagagcgagaccctgtcacaaaaaaaaaaaaaaaaaaatgctgaaagataagctgaccaaatctttttgacatacatgacagcaaaagggaaatctcttgataaagaaaatcactaggacttaatggaatgggcagaggatacaaccctacaattcattgaagaaaaaacaaatatctcctaagcgtaggaaaacatttcccaccatactagctgtgatggttcattttatatgtcagcttgtgcccagacatgtggccaaacattattctgggtgtgtctacttctggatgagattgacatttgaatttgggtagaccaagtaaagcagattccccttcctcatgaaggtgggtctcatccaatcagttgaaggcttgaatagaacaaaaaggctggccctcctgcgaatagaggagctcctcctgcctgactatcttcaagctgggacatcaggttttttttcccctgggtttggactcaaatggaaacattggctcttcctgggtctcaagcctgctggcatttggactagaacaacaccattggctctcctgagtatctagcttgcccaactgcagattttggaacttagcttctaaaatcgcacatgccagttccctctactgaatctctttgcatatcaatatcatctctatctatccatctctcctcttggtgctgtttctttcgagaactgtgactaatgcgctgggcatcaaggatatacaaattaaaatcccactgatatgctagtttttctcatgcctcttgattttttgagaattctctgggattctcctgatcagaatctagacaaagcttatccaatgtgtggcctgtgggctgcatgcagcccaagacagctttaaatgtggctcaatgaaaattcataaactttcttaaaacattatgagtttttttgctatatatatatatatatatatgttcatcagctattgttagtattagtgtatttatgtgtggctcaagacagttctttttttttgagatggagtctcactctgtcacccaggccggaatgcaatggctcaatctcagctcactgcaacctccgcctcccgggttcaagcgattctcctgcctcagcctcccgagtagctgggattacaggcgcgcaccatcatacctggctaatttttgtagttttttctttttttagtagagacagggtttcaccatattggccaggctggtcttgaactcctgacctcgggtgatctgcccgcctcagtctcccaaagtgctgggattacagccgtgagccactgctcagcctcaagactgttcttattcttccaatgtggcccaggaaagccaaaagattggctatccctgatctggacattcttaagtgtctcccaacttaaaaaatgatctctctttattcccacagctgtgtcaaatcattagctcctcttgtccctctcacagcccactttctttaaactgctctcaagacctgcctcttcctctcttgccatccagtcgtcaaacccttccacgtggcttcccacctgtctctcctgcggaacctcatgtctgggtcctcatcagggtctgcctgtccaccactccaggggcgccgtttgcaggactttgatgggggtgatgccctgctgtgcagtacagctgccctgctgcagatccctgggagcttgcagccctttccttatcagagctttcaggtacatttgacccgaggctggtagaggtgaggtttatgggaggagaagagaagagagccttccacggagtttttaacccgcatttctgccccactctttggaagtaaatgagtacatgctatttccttgctatctcaggtaggaaaaacaagctccaaagagtcatccttttcattttatttaactttgtgtttaaaaatgtaacagatactccgttaaccctgaaaatctgaacaagtcttactagttctttctacccacccaccttagcttgccttattattattattttttgtgatggggtctcgctctgttgcccaggatggagtgcagtgatgctatcatagctcactgcagcttcaaactcctgggctcaaatggtcctcctgcctcagcctcctgagtagctaggactacagacatgtgccttcatgcccggctaatttttcttattttttgtagagatgggggtctcactatgtttgctcaggctggtcttgaactcctagcttcaaacgatcctcttgcctcggtctcctaaagtgaattcgctgtattgttaatgtgcaaatcgtagcatctggcacataggaaaaggtataggagctgtcatttgaacccaggtgtcctggcttcacaatttgtcatttatgtcctggatgctggttgcctctagcctgttctccccccagcagccaaagagaacattctaagactaaaattctatcactctcccagtataatagaagccttcaaaggcttctatttgcatatacaataaaagtcttgcctggcccccgcctgtctctccagcctttctttcccacctgttccttcgatcactttggtttaaccacagtgacctcatttatgtttctttttttcttgagacggagtctcgctctgtcgcccaggctggagtgcagtggcgcgatctcggctcactgcaagcacggcctcttgggttcacgccattctcctgcctcagcctcccgagtagctgggactacaggagcccgctaccacgcccggctaatttttttttttttgtatttttagtagagatgggctttcaccgtgttagccaggatgctctcgatctcctgaccttgtgatccgcccgcctgggcctcccaaagtgctgggattacaggcgtgagccaccgcgccccgcctcatttatgtttctagaacactcagcacttgctcatgtcaggaccttcggctgagccgtgccttctgccctgtcagctcctccctgctgggtttcctgtggctggttcctgctgttccttctggttaggcttcagattaacccccacctcatcagagaggccacccctggccacagtttaaggagccagtgagtgccccttttattggttatcccagttgatatggtctggctgtgtccctacccaaaatctcatcttgaattataatccccacaatcctcacgtgtcaagggcgggaccaggtggaggtaattgaatcactggggcagtttcccgcatactgttctcgcgatagtgagtgagtctcacgagatctgttggttttataaatgtccgacatttcccctgttgcactcgcttcagtttgctgccttgtgaggaaggtgtctgcttcttctttgccttctgtcattattgtaagtttcctgaggcctcctcagcagtgcagaactgtgagtcaattcgacctccttcctttgtaaattacccagtctcgggtgtttcttcatagcagtgtgagaacggactaatacaccagtcttttgttggtttccttttcagcacttttcatagcttgcagttttcttattttatttatttcgttttattctgagacagtcttctgctgtcacccaggctggagtgcagtggcgtgatttcagctcactgcagcctccatctcccaggttcaagcaattctgcctcggattcccaagtaggtggggttacaggcatgagccatcacgttggctaagttttgtatttgtggtagagatctggtttcactatgttagccaggctggtcttgaactcctggcctcaaatgatgcacccaccttggcctcccaaagtgctggaattacaggcgtgagtcaccatgcctgaccaacttgcaatgtttaaaagttgatttgctgcttgctttggctcttgtccattagaagctaagctccacgaggacaggagctcccttccctgagtgttgtggtgtgcccagccccaagcacaatgcttgggacatagaagacacttagaatggagaactatccaccaaattctcccctctgtcccactgaacaaacagcactgtttcccagagaggtggaaggataacaagtgggaacttatctggctgagactggtagcagctgtagatttgtgaagaagggggcagcctgtttacattcgcttatttatttatttatttatttattgagactgagtctcactctgttgcccaggcttgagtgtagtggcttgatctcggctcactgcaacctctgcctcccagctcaagcgattctagtgcctcagcttcccgagtagccgggactacaggtgtgagccaccacgcccggctaagttttgtatttttagtagagatggggtttcactgtgttggacaggctggtctcaaactcctgaccgcaggtgatccaactgcctcggcctcccaaagtgctgggattacaggtgtgaaccactgcacctggctaacattggcttatttttggttctagattgatgctttgcgaactctaacatgcacgggcaatcacttgggatcttgttaagatgcagattctgatgcagtaggtctggagtgtggcttagatttggcatttctaaccagcactcaggtgatgctgatagtgttggctgctttagggggtcacatgtaaagaagcaagggcctggttctcaaatttggctgcatattggaattacctgggacctttacctagaaattctgatgtaattggtctagggtatggcctggttattgtttttattttttaaagtgcacattagtgcagccaagtttgaggacccctgctctggacagtgttttacttcatacataattgtgatcaaataaagacatttgacttgtcagaattcttttcatgaagagcattgcatttttatgacaaaggaaatttccttgacaagcttgcctgagtcacagcagggcctgaaagtgggaagaactcttctgcaaagacaaggtagtgatagggctctgcctaccttagggagaagagggaaggtggaaacagagccgcaagctggtgggtaataaatggaggaaggcctcctgctccttccccttaaatcttcagaaagttaaatagtgaaatgcttgaaaataatggaatttattttaaaggatgccagtgaaagcagtagcagttcccaggcatacttgcagattttaattgcttttaagttcttacaaaaattccaaattagctcaaaatctcagggtaggacacaggccccagaacttgctgaagctcacctgcagattccaacatgcaggcatgtttgggaacccctgggttcagatgagcctcctgcaacccaggcagatgaatgcagggtgcaaaggcagagagaagccagtgtgaggcattgcaggaattccccaaatgcagagaatgttctggactctaagcttatgaaatcaggattcgaattcaagtggaaccagaactccaagccaggagggtcccagccaacaaccgctaaggaggcacttggtttgagagaatggcttcattaagcctgtttccttctctgttaaatgggaataataacacctgtgactaagaaatgttttgaggaacagaggagaagatgtggatagatttgctttgttatgtgctgtatagagaggcagctccatatagctctttgaacgtggtttgctactttacagggcacagcttttgatagaaagggatagtggagaataatttgtgaatctagggtgggaagtatccaccagtacaggaaagagaggcactggctgaatcgccaccttgtggtggaaacttgagttgcaggagtgggagccagaggcttaaaatgagtagacttaaatcgtaccaagcctagcagggtttctcaccctctgcactgttgatattttgggcaaaataattcttttttgggggatgttttgtgcatggtaggctatttagccgcatctatagccttttcccactagccacacccctcccctgcagctgtgacaaccaaaaatgtccccagacgttgccaaatatcccttcccaggggcagaattcctcctggttgaaaaccagggtgctatagaaaacgtcaaacaacaacaataacaacaataataatatcttctagcagtttttgagtgcttaatatttctagtgctttgcctaacatgctaaccactttacatctattgatttctttgatcctcacaacatctccccatctccaatttgaggaagctggccgggcatggtggctcatgcctgtaatcccagcactctgggaggccgaggtgggtggatcacctgaggtcaggagtttgagagcctggccaagaaaccttgtctccactaaaaatacaaaaattagctgggtatggtggtgcatgcctggaatcccacctactcaggaggctaaggcaggagaatcgcttgagcccatgaggtggaggttgcagtgagaccagattgcgccactgcactccagccttggtggcagagtgagattctgtctcaaaaaacaaacaaacaaaaaaaaactgaagctggagaggtcatactttcctgggatgttcccatgcttagagaaattgatggagcttagtctggagtagagggtgtctggagaccaaaatctatattagtttcctaacgttgtaaaaaaatcacagtaaacttagtagcttagaacaacaccaatgtattatcttacagttctggaggtcagaattccaaagtgggtcttatgggctaaaatcagggtgtcatagggctgtgttccttctggaggctctagagaagaatctgtttccttctctattttagtgtctagagccttcctttgcccatgcccctccatccatcttcaaagcacatcattccaacctctgcttccgcagtcatgtcttcagacctatgtgggctgcgtgtctgagggaggcagccccttcctggagccctggagagccttgctgagaagaattcgaggatcttacaggaggcagatattagctgatactgagaagagatttctaaaaagcattcttgcccagggctaggctgggttgtgtagggatttgaccatgggagggagtagctgagatggatgaaggtggaggtccctggagatggggaggtaggggatgcctgacagccaggatgatggatgggttgtctaggtgcaaggcgactctcttaggacgatgctggctattgggtgaacaggagcctgagcagtggccaaagtcttcagtgtgtgaggggatgtggccaggaggtcagaggctgggagagacaaggagagaagggtggtagatggggccagctgcatgggcgtgctgccagggcagtcccacaggcttggaagagccccgtgcttcatggtcgctgtcttgaaattcttcacgattttatacttgaatttgtgttacaatggagagtgtgtgcctctgcctgtcattgcctccccagggcaggcacccacaccctcaccccctgccacttggtcctgttctgatgcacactttttttcctattgactgaatgatgcacactttaaaactgggtaattgagagcagtttaatgaaggggccatttatattcatgtaggcagagggagggagtcacaagggatgaggtggtgtcccgagctagcagctgtagggagcctttagcatctccaggcaaagaggcaaggggctggtggttaccagcactcagagcgggagttgtgtggagagagctccttgggtagagggacacagccaacccatggtcacccacagggaccctgcagagcaggagccagaggatgagtcctcagcctcatcctccctccttcaggtctcctgccagtgctgtctagttcaaccaggagccagagggcaggcggtccataggtcatcctctccggccacctagcagtgggaggaggctcttgagtggacctggaggggccagggggctactggtgggggtggaaaattctgaagagagtcaggttggggggacgtgcccagtttaggcctggcctggtgattcgaggtgcatggagaagtctgggaaaagctggagtcaggatgggagggccttcagcattttggtcgggtccctaccagccttgcacacccaggttggagcagacccagatgtggaggggggcttgggagcctttgcaagtctgttctgtaaaactcactttccattttgcccgggaggagcagctgctggctgggaaaggcttaccctgaccccaaccacctgctcccttttcccagtcagggctttcgccccagccccaaccccgggggtgggtagttttgtctttcccttggcccctggctggcctggccagcaacagctctgtctcctgctgtcaggccaccagaatgtgacaagtggcagatgggcctctgatcaatggaccccatccccaagcaaggacagtggggctgggggcagggtggggagcggccgctaatggatgggcctgagagcagtgacggatgggcagaaagaagctgccatttgtcttggaagtgagtgactccagggaggaggagaagggagggtggctgttgggctccagggtggagagaaagcaaccggagccaaagcccagcagggctgggaggatggggcctgagggtgccctggatgggatgggattgggagaaaggtttttcctacctacctttaactagagctcttcagtcctagccaagagggtcctgacatgttgagtggaagatccaggggcatcctgtaaaaatggaaactagatcatgctctcacctgggtctcattcagggtgaagtcctatccttgcatgattctcctttaagaccctccacggtcttcctcaccttctccttttcctccctgacctcacctctcattaccctcctcgctcatgcctctcaagacaatttactttcttgttcttaaaggtctctaggcctttgccccagcagtcccctctacctggaatgctctttccccagatatcggcacagtatttattttttgagacagaatctcactgtgtcacccaggctggagtgcagtggagcagtcttggctcactgaaacatctacctcctgggttcaagcgattctcatgcctcagcctcttgagtagctgggattacaggcgtgggccatcacacctggttaatttttgtattttttgtagagatggggtttcaccatgctggccaggctggtcttgaactcctggcctcaagtgatccacccacctcgggctcccaaagtgctgggattacagttgtgaggcaccacgcttgggaggatatctgcacagtattcttatgtcctgaaggtcaggtgtcagggcagccttccctgggcactccttataaacagcaatgtctccctgccccatgaccccgtctccatctggtatacattatcactccacctctgccttgttattttaaaattattttgtaacagccaccatctgaaatgtcatttatttgtttactgtctaaggtctgtctcttccactagattgtagattccatgaggacagggcgttgtctcttctctttgctgctctatttccagagcttagaatagcactcagatgggctcaacaaatacttgttgcatgcatgaatgaaagggttctaactccagttttgatgcttcctggctttgtgagtttgaaccatctcctgagcctcagcgtcctcatttgcaaagggagggggactgtccttcttcccagagcccctgtgaggattatgcaagacaatgtgcatcagccaatgcccatattttagagaagtctagaaggcctgggacttgttgaggttggaaaagaaaactgcctcatatctccattcatccagccagtaacaaattctcaaagtaagataagacctgggtctaaggataaaattaaggatgttgctgtaagaccccttgttaaaccctctgaaagacttaaggtggtactagcagaccctttagctagacactgtggtttctaagactcttaagggtccaacaggagggaagaagagaaagagaagcctgtttcaactgaaatgaacctcagtcagatgcatagaaaacccataacattttcaagatatctgtatcagtgaaaacactgtaagtgtgtacaaaaagtgactgcaacttttcaaaataaaaacaggcctctgagtctccaattttctaagagcagaaaggctgaaaaaaactatgtagctataaatatcagccatttcttatgcaaacagaaggatgattaggagaggagaaccaagagtccagagaggaaagttaagagccatagagaacaatggactagggaatcactccaaggaagcagaattggacccgaatcaagggctgttccctgcccctggaagcagagggaattgacaacctgtgctttgctggattttgatgtttctatgaaccagggaccactaagtacctccggttcctcccctttttgtctgggaatgcctattgcgaatatcctgtccctttttcatctttatttatttatgtttgagacagagtttcgctctgttgccaaggctggagtgcagtagtgcaatctcagttcactataacctctgcctcctgggttacagtggttcttgtgcctcagcctcctcagtagctgggattacaggcaggcaccagcacgcccagctaatttttgtgttttcagtagagttttctccatgttggccagactggtcttgtactcctggcctcaagcgatccacccaccttggccttccaaagtgctaggattacaggcaggagccacactgcatccggccctctttttcatctttatatgttgagtatgggggtgagtagtaggagctgcaccttatgaagcccatctgcctctgtccctgattcagaagtgctatcaactgaattgtctcttcccaaagtcataggttgaagctgtaaccctcaatgtgactgtatttggagttaggccttttaggaggtagttgaggttaataaggtcataatagtggggtcttaatctaatagtattggtggccttagaagaggaagagagaaatctctcccttgcttcatggacacgaaccaaggagggccatgtgaggacacagcaagaaggtggctgtctgcaagccaggaaatgagccctcactagaacctgaccatgctggcacctggatcttggactgcaagctccagaactgagaaaataaatttctcttgtttaagccccccagtctatggtattttgttacggcagcctgagctaagacaagaactcaaggttctgaacatgaagctataatggcatgagacattttgtgggaggggagaatgagcatattttgaatgtggaagaaatgaaagtaattgtagcagagagtggaccaaaataagcttaaaaacatggccacaatattttttagtcccttccattaaaaaatagtctactttcctaagctgccttgtcatctgcattgacatgcagaatgtggtggaagtgatatcagtaagctctagagtgtggcaaaatgttaaaaacaacccaaatggccatcatcagggggctggctaaataaacaatgatgcatctatatctggaatgcctcagcactaaaacaatgcctcagagcattaaaaacaatgaagtggatctgtttctatcaagatggtagtatctccaagacatatggtcaagttatgaaaacaagttgctgaatgataacttcaagtaagataccatttatgttaaaatataagttcatgaaaagataccatatatagttgtcccttggtatccacagggtattggctccaggataccccttggattctaaaatcaatggatgctgaagtctctgatataaaatggcatagtatttgcatacaacatatgaacatccttttgtgtactttttttttttttttttttttgagacagagtcttgctctgttgcccaggccggagtgcagtggtacaatctcggctcactgcatcttctgcctcccggattcaagcgattctcctgcctcagcctcctgagtagctgggattacagatgtgtgccgtcatgcctggctaatttttgtatttttagtagagactggggtttcaccatgttgccaggctggtcttgaactcctgacctcaggtgatctgcctgccttggcctcccaaggtgctgggattacaggcatgagctaccgtgcccagcccttttgtatacttttaataatttctaggttacttataatacctaatacaatgtaaattctatataaataattgttatactatttatattatttataatttttattatttatatttatatgatttatattttaattttgcattgttattttgtattttttctgaatttattcagtcagtggctggtcgaatccatgggtgtggagtccaaagatatggaaggctgactgtattttcctgtacatagtgagtgtgtgtgtttttatgtttgtgcctgcacacatacactcgtgtgtgcgtaagatcattagaataaaataataagttctactcaataaccccttccagaatctggcctggggttgacattattctccctggcccttggttagtggaaaccacagcttcttctcctctgagggtgcttcccttgagtctagggtgattcctttatggccctgggtgctgtcattggttcttcctgccaccatggctgccagttccttctccttactgtcccttctccctctgcagctggaagatcattctcgttgatccagaaggcacaggtgctcccaagctgtggcgtgtgtgggtccctgctatccgtcattggcaggacttcagcgtcagcctaggcctccattccttaggagcttcttgccattgtgtcactaaaatgtcacattgtcttgtcctgagccgttcttgtgaggagccagtgcaatgcagaggggaacagaataataggattggccctttttatggccctacagctagctgtgcaacctcaggccagccacttaatattccccagcaaatcttgctttttatgaaatggggacaggagtgtcttgctcctagggagcaaatgtgataatgcaggtaaagtgccccatgcaatggcaggcgtgctgcaggtgcttgcaaaaggattttccctttctgcccctaattccagtgtggctgtaaatcccttcatagctgtgtggctttgggcaagtcacttaacctttctgaaccatacctgtcaaatggtgataatgacatctcccctacaatgttcattcattcattgagcaaatatttatcaaggacctagtacgggctgggcatcatgctaagcattagggatatagtgacggatgagactgatgaagtctgtgatttgatgttgacgattgcctagtgagaaagagaaataaaacaaatgactgtatcgataattgtcatgagcttggagttgaagcaataaaatatgttgtacccagtaggtgcttcaggaaggcagccacccatcacctactgcagtcccagccacaactgggctgcatgaaaccactactggagccccagcagagagctcacttccaccaccctgcctgtggggctcagctcagcaatgctctggcatcttctatattgtcctgtgtgatttctcagaagaggtagactgtcccaaaggccagagcactgctgctgtctgagcagccaagatgccgaagcttcatctcaaactttcattatcctttgccttgggctgtcctgttttcctctcccctcccccctcctttttccttccttctttttcttaagactaggtcccattctgttgctcaggctggagtgcagtggtgccatttcagctcactgcaatctctgtctcctgggttcaagcgatcctcccacctcagctccccagtagctggtactacaggtttgtgccatcatgctcagctaatcgtggtattttttttatagagacatggttttgccatgtttcccgggctggtctcaaactcctgagctcaaacaatccacccccctcaacctctgaaagtgctgggattacaggcatgagccattgcacctggcctgttctgtttcttggtggggaattaattccattctttctaggatttttttttttttttttaaatcttccttgctaaaccagagcatgggggaggctcccagggacccctcattcactatcattcagagtagcaataaccatccattaagcatgatgctatgccagggcactttaccctcatgaactctttgaatctcacagcagccctgacaatattataattctcattttacagagaagaaaatggagaaacaaagaggttggttaaagtgccacagccacacggttggtggctgtgtttgaattcaaacctggacacctgttgccattctgagggtgttctgtaataacatgcctgaatcagagttgggaagatggagcatgggatgaggacaaaggagagaagtccagaggctggctagagatggtaagagtccagagacaagaccctggtgttgctgtcctcagcctcttttgagaagttcctgttatctttaggggaagacaggaggggatggagaagagaatttctgggagacctcttgaatgtttcagttccaagacagtacctgagaagtccactgtgaacagttgcccacgttgtggactccacagctctagatgacaccattcacactgttgtcaatgagaatagactgtttaggtaccctgtagggacatgcattttgcatcctgtgtcataagaggacttctaagcggtactggctagaatgctgcggggacagggagaacctttctcaccttagaacagggtccctgggctcctgctggggagaaagatcagaaagggacagtccacagcaggccattgagtctactgggaagaatgagatgggagatatgggcactgtctctcctagccagcttttctgggtctctttaccctattcagacacacctggtggtctcaccctctgctccccatacatgaggctgaggtccctgcacacccaaccctggaattggagctggagctcaccctccctgcagggatgccggctttcagggccctgcctccagtccagtactgtgagtagcttctctgtccgctctcctggatggcttcttctggggacagcttggggccctaacttgcccatttcccagaatccttcctgcaaccaacttgagagttaaggtagctcagggtggttaaaggttaatgtctgcccagccatttatctgctttgaattgacttatccctaagagtgtggctctttaaaatgcaggagagtgttggagccaccaaactctctcattgcccagtgtcctcccccacccacccccctgtataaatccccagtccccctccccttccttgtcaggaaccgatttcagcccacaatggagatggtttattacagctcacttcctgctgtgagtaaataagtttgtctcctttaaattccctgggcaattaggagaatgaaagactgagctttggattagcatttatttcctccaaacgtttatatgaggccattttcccactgacaaattgtggggcaaattgttctcgagaaactgtctgcagcaaaggtgctatgattaaacggccggtgtaaatttggggtcataaatcctttccctgagttaatgggatttattcacagcaactgccattacaggctcaaagaaataataataaatgaggttgattttgcacctgtttcagggtaattaatatgcacactaaagggaaaagaggttgtttttacaaactgcctcgcctgtggctcaagatttggagtccttctggagtcttcaggtcaatggccagcctctttcaggacagagagctgggagcagttgggaaggggcttgaggcagggagagggtggtctggggtgtgacctgagactcttgcgttgcaggtaacggaacctcctcacgctggcttgagtagtagggtttgatatgagggcaagggggtgagtaagacattcatgaaactcaagtgtggtaatgttatactgaatacattggttgcaagtgacagaaacccaagacagctgaactcctaggactgaaggaagtgttccaggaaccccgggccccagggattggaatggagactcgggaccaccaagtctttctctcttgttctctttcctctctttctctctcatctctgtttctctttgttcttccagagttgacgccaaagttctcctagatggaaggtcaaagtgcaaaaccctcttacattctctagtctccctcacatgggataaagggggtggtggttattcctgaggcaccctggaggggcccagcccttccagaccccacttcaagctcatcctggccagaaggcctccccctcctctcaaggaagccactcaccttataccatccccactactggcaccactgcctgccattttgtccctatgcccaggtgacctgtcttctgctcacagagcttgcccagctctccagccccagtgttgcagcccaggatccctccccagccctggtcggaccgctccctgggaaccctgaccctgtgactccagctactgcctgcagtattgttcccaatggattccccctgaatcctgggatctgagctacactcaggtggggcctccttggaggggcatttggacactggacttctgattcgaagcaagatctgatcccctctgcctgtttctgttctgtctggtcccgttctcctctccactccctagggagggcctgggcagttgaggtcctaaggggcttctcactagaccctcataggacagcagctagagcaatctgtccaaactcaaattcaaccgccctgttttcctgagaggcagtggaagtacagtgattatgagcttgggccctggagctcgcatgcctggctttgaatcccagctcactgcttcctcgctgtctgatcctggccaaatcctttcacctcttggaggcttggtttcttcctcctctatgagatgaagatgacagcagtgcccagcttgcctgtttttttaaagtgtaagtgagatggattttaggcctatgccttggaagaaggagaagggaatggtgaaggagcggaagtgggagtgtctctgatccttgaagccttactagaaagacaggataactggctaacttggattcagcccctgcttctagaagctccttaggaagtctggagagtggctgatccatcctggggcagctagagaagcactcatggaagagaggacatagaagatggggtgttgtgggtgaataggagttcttcaggtagagccagggagaaaggacattattcctggcagagaacagctcatgcaaagtagtagagaaagagcatactatgtgttcagggaatgacttggagtcagtgagaggccctagagggatgtgttagttcaaatatgacagaagtatctaattagatcttttccttaaatcaattaaatcagactaacccctatcccccatccattgaattagcaggaaattcaatttcagtcactaccaaggccctgacccttctggggtcccaaatccaggtgcatctggcaaatcttctcatctgtactccatgcagctgccacagctgccatcctgtttatctgagtgcacagaggttcctgaagcccatgaccctctcccacgaggcccaacatctgtgtccaggcgggacatgccagggcctggggtcttgctcagtgcatggtgtggctgcctcttgggtgtctggggaggacaatgagttgtgatgagtcctcactcctgtcttgtctgtgtagcctgggaataattcctcctttttggcctaggccctcttttcctgaccctctggctctgggtcacccctccaagtcttttcagtggctctgagcttactataaaagccaggaagaaaatgggcaaatgctattttttgttctacaagatcccaagagcaagggcattcaaaaggctctgggtacccgttcaaaatgtggagaaagaagagggaacatgcacaaaaatcaatctctaaaaaaattggctgggcatggtggctcacgcctgtaatcccagcactttgggaggccaaggcagatggatcatctgaggtcaggtgtttgagaccagcctggccaacatggcgaaaccttgtctctactaaaaatacaaaaactagccgggtgtggtggtgggcctgtaaactcagctactggggaggctgaggcaggagaatcacttgaagctgggaggcggaggctgcagtgagcagagatcgtaccactgcactccagcctgggtgacacagtgagactctgtctcaagaaacaaaaaacaaattatgctgccatggtatgatgcaggaggatgagtgccgtggtctgaatgctggcattcccctaaattcatatgttgaaccctaatccccaatgtgatggtatgaggagatgaggcctttgggaggtgattaggtcatgagggtggagccctcatgaatgggattagtataaaagaggtcccagagagctgtcttgccccttttaccatgtgaggacacaatgagaagatgccacctaagggccccatttcctggctcatgcctgactccaaatctgccagtgccttgatttgtactccctagcctccacaactgggaaatgaatttctcttgcttataagccacccggtctgtgggatgttgttatagcagcccaaatggactacaacatagcaactgagcagggcatgatagctgaagcctcaatctgcaggggtttaaaagtcaggctatctagcagtgaggacttgacccagctaggggaaccatgtggtcagatatggggcttagaggtggagctgaagaagattctggaaggatcattttagtggcttcgggatattatagtctctgagactgttgatctctggggcaaagacaaagccagggcttaaggtcaaagctcttgaagctaaatcctaaatccctctgtctttctcttgggattatcctgggagaatgctggaataatagagatacccagaggctacttttgccattctgtatctgcaatatgtgttgatgtctcaaatctcctgtattagcttgctagggctgttctaatcaagtacaagagcctgggtggctgaccagagaaatgtatttgtctcacatttctggagtccaaaatcaaggttgtcagcagggttggttccttccgagggccaggagggaaggatctgttcagttccaggcttctctgcttggcttgtaaatggccgtcctccccctgtgtctcttcacctaggctttcctctgtgcatgtctgtgtccatgtttcttcctcttagaaggacaccagtcatattggattagagcccacagcaatgacctcattttagcatggtgacctctgtgaataattttttcttttctttccttttttttttttttttttttttgagacagagtctcgctctgtcaatcaggctggagtgcaatggcgtgatctgtgctcactgacacaaccacctcccaggtttgagtgattctcatgcctcagacccctgagtagctgagattacaggtgtgcaccaccacacctggctacttttttttttttttttgaatttttagtagagacggggtttcaccatgttggccaggctggtctccaactactgacctcaggtgatccgcccacctcagcctcccaaagtgctgggattacaggcatgagccccaccgtgcctgactattttattttattttattttatttttttttcgagacagggtttctgttgcccaggctgagtacagtggtgctatcatggctctctgcagccttggcctcctgggctcaagtgatccccctgcctcactctcctgagtagctgggactaaaggcatgcaccaccacccccagtcaatttttgattttttgtagagacgaggtctcgctatgttacccgggctggtctcgaactcctggatgcaagcaatcctcctgccttggcctcccaaagtgctgagattacaggtgtgagccaccgagttcggcctcaacttctgtaaagattttctctctaaataagatcacattctgaggtactggaggttaggacttcaacctatgaattttgggggatgccattcaactcataggacctccaaacaagcctacaaaatgcagaagtgatgactattttataaatgaggagttccaggttgagagaggtcaggcaacttgctcagggtttcaaagccagcgaggaatagatgggacttaaactctggtctgctgagctgtgctgcagctgggtgggtcccagggcccctgtggaggcagagagctggattcctgctgaagctggaccctgcttgtcccctcccctggatttttcccagggcaggcttcttagcctgctggaagaaggcagggaggggagaggagggatgtcattctgagcatcacttggccaggccttttgtctctctgttcattgcctgaaatgtgcttgcatcttattacccaagctaggtagatttttgcttggctgagctgagatcaaaaagtaatttttctttttgcaacagccaattagaaattcatttattttcacattatggacatttggcaaaaatttctttggcaatttagctccatttatatagtctgcataaagggagacagtgaggctaggagaaaaaaaaaaggcaaggccgcgggcaaaaattaaatgccgaatcatgtattagaaatgagatgtatttactattgtttttgaaaattaatggtgcatttttagcttttataatgtaatttaatgatgcaattcatctaataaaaaagaacacatttcaactcagtcatacagacctactggggcacagggcggaacaccttttccatggaaagggtttggaatgaaatgcttggggcctttctctttttctgtaaggcaaaaaaggaaaagtggtctgtctgtgtctgtctctctgtctctctgtctctctctctctctgtgtgtgtgtgtgtgtgtgtgtgtgtgtgtgtgtgtgttgccatttggagtatcagtgagaatctaataaaaaggacatttttcttttgccatattggtgtttgtgctgtgttatagaaatcagcctttgattctggaatgttagagggtgttggctgccccagcctgctaagccctagatggaaagaccctggtgggtggggaggagaaaatggccttggagctgtgtcgaggttggtcccccctggactctgagggggtgtgggcagactgggcatccctccggaggaattggccacacttgctggatttggaaccctgtgagcctcctgggtccaatgcatctctctctctttcaagtccaagggcctgattttcacttgccattgctcccaattttgaattaaggcaagaacgtccctcttttcgcaaagaggatgactggaagagaaacgagggcagggagggagggggaggcagggagggaggtgaggcaggcaggccctgaccgagctcctagggtgagttgggcacagtggccactgctttgttgcgctcccaccctgccactagaatgtcagctcttgaggatggagtacatttcctgtcttgttcataccgatccccagccccacagtataccatatacactcattagatactttttgactgcagagtggcagataaaccctgggttaaatacattatgtaaatgtctgcttaactctcactccaataccatgagaaggtgggtaccacgactaccttgtttaataggaggggacacattggctcagacaagttagggaactttctgaagttcactcatctgttaagtggcagggctgagacctaacccatgactatctcactcccaagtacttgctcttaaccacaccaatgtatgcagtgaatgaaagaataatgttaagtatgaatgacaggagggctggcctttctgaaggttaccaaaccaaggggctgggatttgaattcaaattttttgattccaagttaagaacttctttctgggctgggcacagtggctcacacctgtaatctcagtactttgggaggctgaggtgtgcagatcacttgagcccaggagtttgagaccagcctgggcaacatggcaaaaccccgtctctacccaaaatacaaaaattagccaggcatggtggcaggtgcctgtaattctagctacttggaagactgaggagggagcatcacttgagcccaggaggttgaggctgtagtgtggaggattgtgccattgcacaccagcctgggcaacaggagcaagactgtcttaaaaacaaaacataaaaacaaaaaactttctgctaccctatgtaccctcagcaggagggaggaagctgtggataggaaaaggagtttggcaggagttcaaggttacagtgagctttgatcgtgccactgcactctagccttggtgacagattgagaccctgtctcttaaaaaaaaataaaaagaaaaggggctttggggcagggggaagatgagggccattagcgtgggaggccaggggacacataggcctaggggtcttccaggcatggcgatccctgagggaggtgaccagggatagggtatatagttatcccaggggtcaaaggaaatgcccaaaccatttgtattcatttgttcagtgattatttactgaacatctatcagatgcctaggactcacctgaccttttgcagcttgaatttcctcacttgtaaaacaaggtgaatccttcaaagtatttcttgacaaggcgcactgttggtgttttgaatggaacaatcttactcctcggtctgaatggcacttccccaccctcccacacacgtggtgttctctgatcatggggagattcctaaatgctcccagataccctcctcgaatggaaacagaggctttgtagggctgctgggaggactcaacaggacaagctgcaggaaggcgctgtgaacagcctggtgcacaggaggcttgtcatgcttcctttgacatctccctttcccttgcctctctccctttctccttcctccagccccacaaatctgctctgagcatcattttgagccattgaccctgctgctacccagccaggctgtcagtcagctccctcctcctgcctccacctccctctgctcccctgtcctcgcagacctgcgcctggctgcagtccctgcacgtgggctcagcagctgtggacattctgccaccccagccaccggccccagcatgacccaggccctgccctgtcactgaaccttggcgggaaggtcagttatttccttcctttttaggaggagagctctgccctttgggtgcctgccctggtgctgtaccagcctcggatctgggatttttgcattttggggctgcctagagaagttgccaagcaggcatggtaaataggcctctgagtgtttggagtctagaactccactgtccgatttggtagccactaactgtatgtgggtcccgagcacttgcaatgtgaattggggtgtgctgtagtgtaaaacacacatggaatttgaaggctctagtgcccttggggtgcaagcagctgagtgtcacacctctttattttattttcttggatttgattcggggtggctgggcactagattggcccaatatcagttacataggatgatcccttcccctgtttgagccatgtaaatccataaacttggatatatcctcaccagactcccagagttgggattctgattgccagccctgtaacaccagagcctcttcacttccaaggagcagagggggcttcaaaagggaacatgcacaccctctccctcttcctaggtcccaggacttctagggaaaccctttccatcccctgatgcccagctgaagagccagggatggggatcgagggcttcttccgtggaatctcagagcacttgacagaccctgtgtgtttcattccagactttttgcccactgcccttcttggcctgagcccctggatggctgcacactgcccgatgcacttttgtgcctccctgggccaggcacaagtctcacacccagtggtgtggttcaaagtgaattgaggttgtcagttctgcagaggcatttttgcaaaggccctgcatggaggtgccaggtatgaaactgatttaaatcacatcctggagcccccaagcaggtaggagctggtggcagaagtttccatgtcttagtacaggtcctctgcctctgacacacatgctgagggacacctatgtggtgattcaagggaatcttgcacccactgggctctgtgctgcatgctttatacacatgtgctcacattatcttctcaacaactgtacttggtaaggctacaatgatcctcactttgcagatgagaaattgagctcccgagaggttataaaaaactggctgaagtcacacagctggcaagaggcaaaactagtattggtcctcaagttgtgtgaccctagaaccacaatatagcaattctgcttctcacaggtacacatgtacagacccaaagacacatggaaatacaaagacataggtatacatagatgaacatgcatatataaaatgcagagatccatatagatatgcggacagacatatatggacatacccacgttcccatggctactcagatataaaaatactcctatccatgtacccacattcatacctccatgtatactatgcacatacctatgcatacacctcatatacaaatatacacatggctactctgacataaaggtatacacacatgcacacactacacatatttgcacttggacatgaccacaaatatgcagagttgaaagtcccccctcctaccacacacacaagcatatagtgaggcttgtatacccagatatttaactcctgcagaaacacacacacacacacacacacacacaatcttgacacacttctaagaacgcctgcccccaggtatacagaacagcccctcccccagtatacactcacaggcactcactcaagcccaatgatccaatttaaactgaaaagggaaaaccaagttgaaaattagaggggaaaaaaaaagtccttcagaaagtataaagctaataggctgcaagtggtgagcctgctgccttcacgatatcaataactcagtattggatttccaaaaagacatcacataatttttcaatgagaaatccatgagccctggagatgctgttatggtgtgaattacaatgcacacgcttgtcagccgtccccgtcagcactttctcggatgccttaacgggcaggaagtgctgtggctgcagcagggatggttattgttattatttcttccttttggagcctcaaattaagaacctgggaagccagcaggtccctttctcctccctcccctcctccaattgtacccaaatcaagaagttttcctgcttgatatattctttagtgtattcttcagctctcagcctcccctcccctgtcctggagccctaattctgggagagactgacacctggggcttaggaactagggtcaggatacgtgggtgggggccaccctctctatggagctcgggcttgtttaagacttccttgagtgttgtggaaatgataaaaactgcttttccatttccgtcacttggacccagggattttttattgagcagaatcagcctattgggcattgctttctcctgaggttgccttcggggcaggactttggttcagtaagaagagcaggggtccctgggagggatgtcaggaatgatctggacagagggcatagggcatctttcctgagcatatttaggaggaatttgggtggccaagagaaaggatctgagcagaccacccaggagtaggaaaagggggcttgggcactaggggtggggttggggtggattgtggaaattgttttattcagctcaactctcctgggcttttcccattcaccatgaaaagaagatcctccaattagtcactggtcccagagtgtgagccccatggaacatacctgaaagtgacctgcagtcaggagcaaagccagtcctgctgactgcagacccacgagtattgtataccgttgagccacttggggctgtttgttatgcagcattatgaaacagaaatctgaggagcacagggacttctccgtaccttcatgactccctgggctgagcccactgtagcactgtggctcgtggtctagaatcacctctgtctctaactagtatgaggtttaggggttaagagtggaatcccagtctctgggttcaaattctggttttgattatagtattggataagtcatttaactcctttttgtgtcactgcccatttcatagtctcccgtttctccatgcatcattcgggtggggaccagaggcacctagccctcaaatcaggaaaagggtgactccttccctggcagccatccctccagcctgctcaacagccagactccagcttcacatgcctttttgtgcctccaggccatcggtcaggttgtccccttcctgaagcttccttctcaccctgacagcttctccagatcccttgaggcctggattcaaatgtcacctcttttccctgagcatcctgaagcagatgacagttgcccaaacctctccttgtcactcctggattgtgctgtgctgtggttatttgcttgttgccttcaggcctgggatgggctgggactgatcagttgaccctctggcttcttgccagagtttttagcaggagacacacagcatcctgtaccctccgtctcttcctcccctactgagacttgatgcacccctcaccaagggaaggtgaactgatcctgcctgctaagttgctcagtacataattacatacctatcacggcatggggcttttcggtgtacttatcccagccctgatctccagggtgggtatgcgggatggaggcagggaagaagtgctgagcccttgcctgtgggaaggaagaggagggtgatgtcaggaggcagcaaggccctgaggaggagggatggggggtcacctgctgggtgagctggcctggggttccctgggagcttgggcccttcattaacagtttgaggcacggagacctcaggtctggacttcttccaccactgactcacttcttgtctggcttgaagtctacattcaaatatgttgtttcctttccctgagcatcccaagcagatattagccctgcacctgaagctcccaagttccctccatatcttggtgacactcaagtaccatactctgaaatggcggggtgggatggggggcatcaaaagacactagaactttgatttccagttttctacattccataggcaagtaaaataaaacaaatgaaatacccagaggagatacccttatgtaaagagcaggccatatcttttctaagtaatgatgtataaaacagctgtcttcttttattattactatttcacaaaagaaagaatagtttaatagtaaaaactgggagaaagatatggtctcagaattaagcttctcccaagaaaggagagggagcaatggtgcacaaatgtgaatatcatctatattgtggagaagatgttagagcaaaagagaaattgctaaagtattcaacagagaaatatcaaatgcccctaaataaaatgtatagattggaggaagaaattttcagtgtgtgcagaaacgatgatgatgatgatgaggatgaggatgatggaggtgatgatggtaaggacgatgatgatgaagatggggtggtgatgatgaaggtggacatggtgatgatgatggtgatgaagatggaaatggtggtggtaattatggcgatgaagatgttggtggctgtggtgatgatggtgctggagatggcgatggtgatggtgctgatggtgatgatcatggagatggtgatggtgttaatgatggtgctggagatgacagtggcaatgctgatgatggcaatggtgatggtgatgatgtctgacctttgttgagctcctactgggtaataggtactgtactccatggattatcttatttaagacttaaccccatgtattatattcctgaagccgctgcaacaaattaccacaaactaggtgatgtaagacaacagcaatttattctcttatagttctggagaccagaagtctgaaatcaactctgggctgcactccctctggaggctgtagggaagaatgcttccttgcctcttcagcttctggtggctgccaacattccttggcttccttggcttgtggccacatcacttcaatttcagtctcccttttcacactgccttctcctttgtgtatgtcctcttctgacttatataaggacatttgtctctggatttagagcttattcaagtagtctgtggtgatctcatctcaatatctttagcttaatttcatctgccaaggtcttttctccaaaaataagataatattcacaggttccagggacatggacatatcttttttttgaggggtcactgttcaacccactgtatcccattttataggcaaggaagctggatgtcagattctttaaactaggtaaaagttgtacaatgatcaaatggcaaagaaagaatctgaatctgactctagagccttgggacttcatccttatggagacagggtaaagaagagaggctgtgtggaacatttacctcccatctgtgtgtgggggagaggaggtgcttcaaggccatgtcaagctcttcaaggccatgtgatgtaggagggctggatttggtcttaggtaacaggctccaaggtttagagccagcaggtcacaagcagaggaggtaggggttcggggggtgggggtagttagagaaagggcagatccatgatttgggggacttcttagggagcagaattacagagtgtatgatcatgtcaccaagcccagatgagagatggcttagaggagagcagattatagaaatcgagatggaaaatggggaagggataaaaatgagtcaatttggtctaaaagcagtggacaaagaatccataatgtatgaggaagtaagtagatatctacccatgtgtcatttataaattctttctataacagagcacctacctggatcacatgaaaggatgctaaaatttacagaaacaggtaaagaggcatattttgggggtaaagaacagcaatattcatttgctctgtgggacattgctcacatttactcacagtagcttcctgtgaatacttacctgtctcctgtgagatcttatgggggcagggtgggcagagtcaacttagacatgttgaaagctgtccacacttcttccctctggggctggaaacctcagcttgagaaggaaaggagagagctgggtttataacatcttgggatggttcaagaaggagctcacgcctgtcttatgcccagggcaggtgtgatctcttctgggtgtctccctagagactcagttccgcctttggggaaataagatgtcaatgccatggggcatatgtgccttgtccatgaggcatgggtgccctgtccatggaacacaggcactctgtccatggggcataggagccctgtccgtgggacacaggcaccctgtccatggggcataggagtcctgtctgtgggacacaggcaccctgtccgtggggcatagtgaccttgtccagggggtgatgctgtattcgccttgtcttcaaggattctgatgcctaccacagcagactgcagactttcgtttcagctgaaacgtctctacctttatgtgttggttttcacataagaatttatttaagacaagagatgaacaaagtttccagagtacagcatgataatgatctgtctgggaatacttatttttcctgcgtgaccccaggcagacctagggcctatccagtgtggtcacatatagttacaaaggccatgccctaatagcccctggggttccccttcacatgtcagcaatgtgaactgcaccaccaagagatgtgaagtgtgctggtcctggatctgcctctagctttgactgtgcaccccggggtccccaggcttggtgctccctctagtggcagggtagttgtggtctgtaagctctcagtcttgtgatgccatcaggagctccagaactgggaacaagttttggggagcctgcatccctggtctgacttgagcattcatgagttcatgcccgtaataaatactgagcgccttactgtgtgctggcattgtgcttatcacaagaagaaaagatccctccctcccgaaggagcatctaatctactgggagaaacagactatgaggaagaacacgaataaatgtgtgattaagatttgtgaccaatgctatgaagaaaacaaatagagtgctgacatagagacaaggggtgggggtgacaactgagacagaggcattaggggaggcctctctggaaggtgacctttgagctgagatctgagggatgaggtgattgcatgagaagaggtaggtaagagtgtcctaagcagaaggaacagtgagtgccaaggccctgggacagaagagggcattgcatgtccaaggagccacaggaagcccattatggttggagggtcatgggtaggagggcctgaagcttcagaagacatccagatgaggctgcagtcaggtggatgcaggcatccagatgaaccctcgtgctctgtctctgaatccctaccagtggaaccgagtgtgaggagttaggggttagcagagtgttagagggagcctagagaggagggctcttaacatttccagggaattaccaaatgtctcccactgagctgaggagattctgggccgtctccaaaagtatattccagaagggaagctaccttaacattagttaaggtaattctatttcctgtaacagaaccccccgccagatctcagtcacttaatatcctagaagtctaattctcacattaagtccactttggtgtttggcaggtgactttctctgtggtgatgcagggacccaggcacccgccatcttttagctctgccatctcttaggatcttggagtccttcccttccatctggcgagcagtgaaaacagcatgtagagctttgcacaggaggtttttgtggactgggtttagatgtgtctatgacttgcatttgggtgtggccaagtaatccagttactgaattactgggaaacagaatctacatggatgccctccaggtagaggaattgggtgctggtgaacacacagtcatctctgccccaggcctctctttgagtgacagcaacagtatggaccagaagctttgtgctgtggcttcacattcaagccacttgggcggctgccagcctcctatcccaactgattaaatcagattccccgggaatggggcctgggcatctgtattgttgaaagcaccccaggacgttgcagcacacagctgaggttcaggaccaccctgaatggtggagagaggagcttctgggacagcagtcacagctgggcccatccttcttcctgctcaataatcatcattatgccttattatcttcttaccaggtgacaggctagagtggcaggaaggaagacaaaagaagttatttacaaataaaatggtcggtcttccgcattctagggcaggggctgccttcatctcaaatgtgggaggctctttggcagtgggcaacaactttaatggctcctcatggttgagacaggtgaaccttaccttggcaggtctagatggtgagagcaggagaaatagataactccattgttcagcttgggtagaattatgagattcccaggaaataatgtgagaaagagaaggtaagtgttccatgttaaaagagtagaaggaagatgtcagagagtgggtcgggggtagggagacagagagcaagagcgagtgagagacagagagattgagtctatggtaagcagtcatggctcatggaaagaggggacaatgagaaattccctgtggcaggaatgaccaatatactcctaggaagtatcgtgtccagcattaaatttgaagttgttctttgttctataattgttttcctacccataaacgtttaataagtctcctatgtacaacagccttgtattaatgaagtcttgaaggactgaaggaaggaagaagtgtgcaagttagagttcttatttagcttcaggcagggaaaaatggaaaaatggattctgactaagcagcagaggaatttattattgggtaagccagtgacactgtgacacagggactcatacaagtcacccttcaaccactgggtggatgtggctggcctttagataacctcttactcggtctcttcaaaacatctctttccttccgtccttctgatatgatgcgcaagagcagatgagggcagggatggcaaacgtgagcccttctacttcatccttggcagacatcactaactgatctctgtgcaagttcttatggagctcaggggcagctccctggaccctttatatttcctgttccgggcagtcattactaacagatcacagatgatatgtgaaatacaatttacttctgttccagggtccatatgacacctctttcaaggcaatgtgtgtgcaatttaaatgacactatctgtctctcagcccaaagcagctgaggattccatgtcccagggacaaagagttgcccatcctgggggcccactgctacggatcttgcagaaactcaaaggctgccattcattcttgggatgctagtcttggggcagagcgggaagacaactcgcttgggtgttacaacctcctgaccccagcttcctttggaatgtggcaccccaagcctgcctctcctgactcccagtctgtgggttccactctgctctgatttcatgatgcatcctgacttcatgggttctaaaaacaattatttgctagctttgtgcccaccccttactttcaatcaggcccagggtggcagagagtcatggggctgccagttttggccaggctggactggggaggggatcggctacccctaaaggaaaagctcttccagccaggaattgcctttctcttcctaatgtgagataattggtttcctttttacctagttcctccacagccttcgtaattactgccaaacccttgtccctcgactttggcattcccaccaatggacttttttccaaagggaaagagaaaaaggcaagaagactcagaatgaaggcctgggctggatttacctcctgagtcatcacctactctctgtgtgaccttgggcacgttactcacttctctaaattgtcctccctaactaacagcttcctgctggaattttgagaggatgaggtgatttaaatgcttagctcaatagcgcatggtgtggctaaacactcgggtgaatactagtattgtttcttgttacctttgtgcctggtggtttgggctggggtgtgagggtcaggctttggggtgctggttggggacttgtgccttctctttttctttccccaaagcttctggaactaagctctccctcatctcttcaaggaagatgtgacaccaagtgtgttttagcagaaacaagacccatataagtgatccactgaggggccagcaggctaatatgatgttctgaaaaggggcattttattttgtcaaattgctctggggctgctgaactttggtggctgtttcttggcagtgtttctggacatcttgttcgcaggtgatgagaggaagggctgccctgacatcttgtacaggtgagggggctggaggcttccttcctgcgcgttccagccagtgccccgcctgcagtgggggagacattttttcacccggttcaatgtgcgggaggaggagggtgaggtgggggcatgggtagaggggccagtgggaggagtcccccccacagagtcctctgttagaacaacccagaagtccccctccccagcttggggagcctccagggcccgttcccaccccagcagccccctccccagctgggggaggctccagggcctgttcccaccccagcagccccctccccagctgcgggagcctccagggtatgttcgcaccccagcagccccctcctcagctgggggagcctccagggccggttccaccccggcagccccctccccagctgggggagcctccagggtctgttcccaccccagcagcgtctaggctcgcttcctgtctccccgttttcttaaaagctgtgtgtcagcacaggagtggcaggtgtgttaactcccggagcctgcgcctgtgccccagcatgggaagaaaaatgccgactcggagagaatcagagtcaggcgctggcactagccttgggggcaggagagagttggtcgaaaggaagtgttgggagaaggccaggtggctggtactgaggtacccacgcctgcttcctctgccaggaagagagaccccccactaaggtaactgtgagaagtagggcactgtctccctccctccctccctccctctttccctctttccctttttttcctttcttccttccctcgtttcctcccattttccccctccctatttccattccttttttcctttcctccctccctccctccctccctcccttccttccttccccctttctctccctctcttccttcctttttgccctctgtcctttttcccttcggtccttccttttttgttcatttctgcactccccctcctccccttcctttccttctctcctcttctcttcctttccctctctcctattctctcccttcctcctttccccctcttccttctctcccacctcccttccttcctgttttcctcatttgcatccctgcttcccctgtgctctccctcctgtcctccctcctcttttcttgtctctttcctttctcttccccttcttcctctctcctcttccttcctccctgctcgcaccatgccactcaatgctccaagctggacacagctgcagggaaatagcctcagccctggcccccaggagcttccacctagtgggagccaggcaggtggacaggtgatgatcctgtcacgtgatccacatgctaatgaagatctgggctggtctcctgggagctttgctgggtctggaggggtagagaaagccctcacagagcaggagacctctggcctgggtctgatagtttctctggctgagtcaaaagaaaggggcattgtaggcagagggaagagcttgcacaaagtagggggacatggtcaatgaattcttatgcaaatttggaattggacaagcctaggcttgagccactgtcagtataacctctgcccaatcatttcagcctctctcagcttctcatctgtaaaatggggtatgttagtactcatgatgccctgggatgtttggggaacagaattagctcttgcatctgaaaatatctagcactatgtgtcttatcacattttaccctcatgtcaacctggggggccgggtacaattatatcttaattttacagttctggaaatggtggctcagagaagttgagcagcctgtccaagttcacacagccaggtagattgaagacacaaatgtaggcagcctgattcccaagcccgagtgtttaataacaatctctccaaagtcagcacatacacttggaataaaactaacacatcaggtgcctgctctgtaaaatgaggttgcacaaacctggcaggatgacagggataactctccagagctggaggggccatgggggatgcacttttgatttttatggcttctcagggtcccaccaattgtactgtcttagcctgtgtctggttggtgcaggaaaaaggaggatgggcagtggagcaggaggaagaagggggaggaagagcgagggaggagggtgcattggagggagcaggaagaggaggagagggaggagggagaggggaggaaggaggggggaggaggaggatagagaggagaggaggagggaaaggggaggaggaaggggaggaggaagggggaggggagggagaggagggggaggaagagtgggaggatagaaaacgggaggaggggaaagggaggaggaaaaggggaggaggaggaggggcagggggaggaagaggggaagggaaggaagggaaggagggaggggaagggaaggaggaggaggaactctctgaccctactcccgaatctgattctgtccctcttttccagttccctgcactgaggtgttggaaatccagctttccagtggaggctgcctgggtttccatccttgtagctgtgctttttctgttcctctgggacttttcttcccttgaccccctttctttcaggagctcttggtcttgtctgaacagcttttgtctaagaagcctcacagactgccctgggcaccctttccttctccttgctctggcctctactgtcagtctctcctctctgttctccctctcttcccatccttccaagaaggtgaaccgtgggacttctgaggtctaaagaagggtcctggatagggactttaggagcccagaccggatggtcactggagagggacccttttgtcattatgtagactggccacacgatggctccctgggaccgtcaagcacctgcccagtctcttcagtgggcctctggtcgccctggtgattattctttcccttaaatgttccacacgcacctcttccttatctctgtagctgggcagccaacttctgggtttcctgctcaccctgggtagagagatcccagtcactggggcttgcgttagagaggagtggagtggggagaagagcaggaggggagcagaaagagaagtgaggggcttgccagggggctagtggctgagcagctgtaggaagggacttcgtggagttactgatgggctcagccaccaggagctgggctctggggaatctttaggagtgagaaacagagcctggatgtccattccagggccccaaacacaaggctcacttcctggaagcatgaggactggaggtgacacagaaaaggctggcgtgaacttccagacacctgaggagcaagagctcagagttccagctggaggtggcccggactgcagacttggccatggccagtggtggcccttcccggacatggcttggagctgatggagctgctgtttgggacagcaggatgtggcttgactcgggcactgaaaaacaaggctggcttttatgaaaaacaaacaaaaactcaggtgaccagagtttcacgcatgctcagaaagcagtggcaagttaggattataataataatgttataacaataataatgttataacaataataatgacagtagcaaataaccatctttttgaggatttatggaacatgtcagacactgcttttttttacatgggttgttttgtttacatggattaccccataggggaggtaatagaaggggatttataatgacagtcaaacctgaaaaggagacactttgttttagcacaacaagacccagggtacctgcaggctggagtgtggctttctcatgggctccaggtgattgcagggatggagagagaaactcgtccatttcacttgcagggtacacagggacttgccatcacaacctttttcatttccaaccattttcttcctgttggaaggaatattcctcagctgaagttggatctgatttaataaggcaataaccagagaaatgcatttcaattgattattaagcatttgtttattaggactcagtagctctgacccaaatagctgctaagcagtcattaaacatcaaagaagatgtttctgtttatatattttgtttatttaccgtcatgaacaaacattattgcatcaattaaatgtcgattagggggtctatggtttgaattagattatacacatagtgtcaaatcattttcgtgtctctttctgagatataatctatttttgttttagtatctaaaaggattccatctaagtgttagaagctgtggccggcaggggttacggggtggcttctgagcacttctaaagctgatgtttccttttttggagtttgcagcctggatccctgtgacagcctggaactcctgatccattcctcattgatcattcatgaaggggccatttctctgcgattctttgcttttttgggcattaattttctagaaaacaaaacaacacaacaataactctaacctccatcataaaacccttagatatttatctccaaggcagctaaactgagttgtggaaatgaaattaagttctccattaatgctgcttcaattaagcagcattgaaatcaggaatggtgtgcttgaaagaatatatgattttcctagtcacagtctagaagcattgaaataacatatcttaatatatttttattcaaaaaaattggataattttctaattatatgagacaactatgtgtatttataaaatcacatataaacctgagcttaattttttttaaattgataaaattatatatatttatcatgtacaacatgatatgtatacattgtggaatggtgaagttgagttagcatcctggctttttaagtcagaggagaggggacccgcaggaggaccctggctgaattgggccccatcagacccagaatggaacccccccggtccccagaatttgtcctcctgttgtactcagtgcgttggtggaagcagaactccccatgggaacaggcagacctagattttctggggtgggaggggaaggtaaaggtgcaacaaattgagatttctccctgccctaactcccaacccagcccagaaaagaactttgagtgaggccagcagtggggaggctgagctctggcagcctcaggggtcagtcctgcagggtagcgtgcggggatctggctctagccacatgggggctggcatggatgccatgaggctcagctacccctctccttccaccttgttctttctgggcaggggcagccctccagatcccagtcagggtttatccaggggtaaaggagagaaagaaaggtgagagtgaagaggagagtccaggtgagtgagggaacagcttgaagaggccagccatttgcatattaaagagcctctcggctggatgtggtggctcacgcctgtaatcccaacactttgggaggctgaggtgggtggatcacgaggtcaggagatggagaccatcctggccaacatggtgaaaccccatctctactaaaaatacaaaaattagctgggtgtggtggcacacacctgcaatcccagctactcaggaggctgaggcaggagaattgcttgaacccaggaagcagagattgtagtgaactgtgatcaagccactgcactccagcctgggcaacagagcaagactccatctcatttaaaaaaaaaaaaaggcacctcaagttctctaacgcttctagcccagaagttttcaaactttcttttaaatcaatggaactgttttatcaagtgacatcttatttcagtgaaagtgtagtatatatgaagtttaaacacagttgaagtggtcagtgcagggtgcctctcacttgccccctaagcactccctgccatggtacccagaggcgtttctgcagaaatcctcttactttgtagacgtgctttgaaaaccactgcattagtacactggacagccctgtccttaaaagctagtcgccagcccagcatggacaacagaagaatccctgggaatgagaccttctcaaagtcccaggcccacctatgaacattcagatttcctagatctggatttcacccaagaatgtacttttaacgagagccccaaatgattctaacccagtaggctaggctggaactagggtgaggccagcaagtgcttggaactgcacttacacggccttgagagtgaagcctcctgaaattttatactgtaggcccctcactggcctcactctggttctggcccaggtactaaccatgtgaaaaccaacacccagctacactctggggtttggctgcatacagaagtgctcagatggggcttgaaagaatgaatgaaagccatagagatctgcctcctggtgtcccatgggacagacagcaaagaaaacaggttgtaggcaatattcatagtcatttttattactgctattgttaggaatttattttttgatgcttgtaaggtacaagacacagtgggaaacaatttataaacattctcatctttcacctttgcatcagccatgtaatagttcaatttgtaaatggggaaacgaaagctttgaaaggtgaaagtctcgtccaaattcacactgctagtcgtgatgcctaatattctccatggcttgagctctttacctttctgctgtactgaggataggtatacggcccttccttagcatgggggatgatgttcctaaatgaccctcactaatataatagcatccattatggactgtagtcactgtgtatgtttgcccagcaagcatcctcatctgcttctctgaagcaaatctcactcccaccctggccacaggatcacttgatccaggtctggccaatcagaatcctccattgccctagaccgtgattagtctgggagtagacacggggtctaagtcagaccaatcagatgcctccccaggatttccagttaggagctggagaagctgacttgcctctggggtcactgatctggaaggaggtgaggggttgctcacagccagagctctaggagagaacaaagaagaggaagctggtgacccagtcttgttggcaggtccttcttcagttctatgaggtgcctgagcatgtattgctgtcagctgtggcagaaaatagttttcattttttactttaggctagtttgagttagttttctgtcacttgcaaccaaagaatcctgatgaattcagcatccaacattaacatcacagtccctctactctgagccctgtctgaaccacccgccatcccgctggcatttcacagtggtgtttgtgcctcctttctcctcccctgcagttcatgccttttcacagattggctgaggattctctgaacactattcactcccagaaagttcccaacaccacctgaatgcatttatcttttaaaaattatggtagaatacacacacaacatttatcatcttaaccacttttaagtatatttcagtggtattaagtttattcatactgttatgcaaatcatcaccaaatcctcatccatctccaaaattcatttcatcttacaaaactaaagctctgtacccattaaacaataactcccatcccctgcctaccctcctctctccagcccctggttactaccattctagtttctatctgtgtaaatttgaccattctaagcaactcatataagtggaatcatataatatttgtcctttggtgactggcttatctcacttaacataatgtccccaaggtttgtccatgttgtaacatgtatcagaatttccttcttttttaaggctaaataatgttccattgtatgtatataccatattttgtttatccattgataaacacttggattgcttctgtgtgatagctattgtcaataatgctgcagtgaacatgggtgtgcagatatctctttggcatactgattgaaattacttcggctgtatatccagaaatgggattgctagatcatgtggtaattctagttttaattttttgaggaactgccatactgttttccacagtgactatgccattttacatattttacattcccaccaacagtgtatgagggttctaatttctccacatcctcactaatgccttttttttttttttttttttttttgctagtagacatcctgatgggtgtgaggtagtcctaatgcattcttagtaatgacaattgtatcagttttgctccataaaaactactttaaaatcagaggcttaaaacaaccactatttactcaggtcatgattctcttgagttaggaatatggactgagctcagctgagtggctcttctggtcttggccagacttacccatgtgtctagggcaagctttgtgttgacttgtctaggaagacttcagctgggatgactcattggtgcttcatgccatctctcaccagaaagccaggcttgctcacatgaaggctgggcagagttccaagagaacaaactaaagcattcagtggaagtggcacaacattacttcctctgaattccactggtcaaagcaaatcaccaggccagcccagatttaaagtgtggggaaatctctgtctcttgataggagggtctgcaaaggcaaattgcaaagggatgtggatatgagaagtgaataattacaaccaattttttttttttttgcaaaatctagcataacaacttttcaacaagctttcatgtcagacagaaggaatttgcatttgagatttgctccaatgggctcacccaattcatgagtttcaaaggctgtggttcacacctgcaaaactagactatgctgggaattgtggaatcaaggctaatgcctgataatttcaaatgagaattttttccttctaaaatcagtggatatttctgaataaattgttctttcagtcacgaatcatggaggcaagagcttcaattctccattcatttgccataagcagttgactcaaggacagctctgactgtctagccctgtctattaatgagtgccattatacaattaacttttccatcacctttagaagatgccaagccagactcctcctcaaagcccacagtgaacaggggagcctccacggagctccatagcctgcttagatgttcagaaagtaaaaaccaactgaaagtgaaagacttctaaagctcagagctttcccagtaactggactaatggagagtacagccagatccaaatggttggaactgttgccagggaagtaaagggaagtaggtacctccaagcattttattaacctggtaaatcagtccctggaagcccactgggaaggtttggagcaagtttcctacttcgttattttagtcactgctactgtaatgctgcataacaaaacacctcaaagtcagtggtaaacaacaagcatttatttttctttcttatgggtctgtgggttggctggggttcaggggattttggctgggccaggctggactccagggaggatgtgggattcagatctgttccacagagctttgttctccttggagcagtggctctccagagcatgagcttcccatggagaataggaggagctcagagggcaagtaaaccatctgtgcccacatgaggcttctgcctggtcatgcgtactatcatcctatcagccagtgtgagtcacgtggccaagcaaaacatccatgggggtagagacataagcttctctcccagtgggagagcagtgcaagcactgcaagttacgtggcaaaagttgagatgtataatcttagtatggtggagtaagaattgagactgaaaacagaatctaccatatttacccagagggggttggaggttgaggtattgaggttaaacctatgttgtgtgcaagtgaagttttgtatttatctaggaatgtctgaaagatggctgggctgaatcagcaggggctattgaaatgaggaactgaggattcttaggagagtgagctcctttggggtaatagagaactgggccaaggagcttatccaaataacacaatcccagtccttgaagagaggggcatttctgagtactccatgatggaagtctctgttttttttccctgtatgacccctatccccaccattgactcatgactggtccctggggagagttgattattccaataaaacattgcgagatgttggggcctaagcaccattgctatgagtcccttctgggggaattaaacatggaagagggttttttttttccccccaaatcacaattcttcaccttggggctttgaacccctgtggccctagacatctgcagtgactgtggctggcagcgggtaggaggtggcatactcagtggtggcagaagcggtgtccaagagaagcaattgtaccaggggaagcaatattggtgcccacctatcaggaatggcagggatctggacaggtagggagaggcaagattgaggaacagggaagggtgtcctgcttggagatgtggcctgtaccctgggcacactccaggctcagcacactctctagcacatgcagtggtcccagccatattcaggctaaggcataatgcttaggcagcccttctatacttcaggaatgtgatgggttcatttattcctatcaggccatgacagggtttgcaaacaacctttttaacactgttcctttgttcattaagtatcaagtaccttctctgtgctaggtactatgtaagggatggttgaataggaaacattttctgctttgcaaagctcttcctcttagtgcaaagttgggtaaactatttcctgtgggccaaatatgacccaccatctgtttttgtaaataaagttttattggaatgcagccatgctcatttgtttacatattgtctatagctattttaacactatgatggcagcactgagtagttgtgacagagactctatggcccgtactgcctaaactatttactattggcttgttgtagaaaaagtttgccagtctgttgtctagtggaaaagagaaacataaacagatgaacagataaataggcaatgacaatgtagcgtgacaatactgtgacagaagtaagtgcttggctttggtgggaagtaggatcagggaaggcttcctggagtaggcaatgtctataccaagacctaaatagtgagttcagaaattttggcaaaggtgtggggagagattgccaacagaggaaagcatgaacagaggccagaggtaagagagaacatggggttttgggtggtgggagctgagagaagaggctgggaagagtgctggtagcatgttgggcatctcgtcgccattcaggaaggtggcatccatcagcggtgggctgtgcttggcactgtgctattgatatgaatgtgttctcaattccttctaggactggattttaatatttctactttacagatgtgaaatgaacatggcaataaaggagctggaatttctggaggcagggattttctggatggacgattcacgtgtgtttgccacatcctatgagtgctgggatgggttgtggttagaatggtgggggtgtagcctggccttgcctcattaacttgtggtccctgtgctatgcatttcaagacttgttccagtcccagagtgtcctgtgcccacactcagcctcctactggggcccccacctaagacagggctccttgagttgtgggttgagctccatgtctggttcttcctccttttcccatcaaacctgtgccttttgctctcaggctccaacaggacctgcaaatccacacttggggcaaagctccatgactcagggcagctaccctttaatgcttagtgtgaggcgcaagcatcatcctgccccttcttgtgctcagagcagacttgctaagggatcaccaaaccttcccattgaatccagacacagcctcagaatcctgctcaacacagccctccactgatcacccagcatacttgccatcctttccttaacccagagggaaagcttgagctcacgcagtactttctgcacaaacctagtcactgctcgcaggtagccagcctttttgtcaactctgattttgacccgggactcaacacaattcaacaaatgttcaccgagaatccactaagtgtcaaggagcagagatgaataaacatggtctcaatgccctaaggagctcacattctgatgagagacgttattgacttgagcaaccactgaagtggcagcctttctctgctttttctcagggttgtgctgaccgcacgccctgcagaactggactcaggcttccccatctgagatgtggctatgcctgggtggggctgcgtggctaggacttctgcatctcagaccagagggcagaagatgcagatgaggagggggagaggaccccactggaatggcagcagctcaaagtaaaggatgaggtcaggtttgcaccaggttaggatcaatgaacagtgagcctggcctgagcagtgggtacagcactagggtttctggaatcttcagataagctggtacactttgggactctggccacccattctctccaggcccagtgggggaaagagctgacaagcacaaagctacagtatcaggacctcagcctccaaagcagaaacagagcaagaaggaaactgaggcaggggagtagccagcccgactccacagcaggattgggcacacatgcatcaggagtcgtgcagatcaccaggcttaggaagacagcagctctaggaggcttgagggctgatttttctgatctactgcaccctgaccagcactggtttagggacgctggagagtgggttctccccatgttaggactcagtgtgagagctgcttatgactttgccaggttttttctttagccgctgagacatctctccaccccaggatctggcaatcacatcaatcccaaaaggggcacctaaagccttcaactatttgcctttctatggagatttccagaatctactcagttgatgccataaataggtagagaagggagtgtgtgtgtgtctgtctcagtctatgaacacacacacacacacacacacacacacacacacacacggagtcagacctccttcatcagaatcagtttgcaaacttcatttccttaggatgaagagaaaagaaaattattattaacatatcaatggcacctccatgctgagaacaagattaccctcagtacacacaagcgcccagggaagctcagacactgtattttaaatgtgctctgtttctgcatctccgtctcccccaccccacccccattcccttcctattttttttttttgttcctctaagcttgtttctcttgaaatttccaccttgtggttgtgtactgctgacttcacatttgctgtggtgtgaactccacatctgtgaatggatgacaggaaagattaatagccctgctctcttctccttgactgtgggcccagctaatgaataaataaataaataaataagcagagctccaatcccctaaatagagacccagagccagggagaaaacagcatttcgctgaatccattctttaaggaaaaacccaacctctaatgatctctgatttacatagtcggcagtttttcactaaacattttacaaagacacaaaagtgtggggtggagggatcgctccatgttctttccagatggaggcaggggtccccctgagaagcccacaggccaaacagggctggtgcagagtgtgggctagctatggaggtgagccggtttcccactcaggccgccttaggcctgggatcattgagtcgagcgatgatgaagagggaggcaaagggacccctcaggggtcccggtagttggtccccacacttaccaggtgggaggaaggtgtgggctcaccaggcagctcagaaagcctacgagtgtaaggggagggaggcagggagataattcatttcctcctgcttccttcatgcctccagttctggtgaaagagaagctcagatatgcgcagacagagcttctcaaacttgaatgtgccctaatgacctggagatctggttggaatgcagattctgatcagtgggtatagggtggggctgagactggccaattccattaagcctgcaggcgctgctgctgctgctccaggggtcacacttagagtagcaagatgttgcagaggcagcagaaagtcaggttctgccccctcctctgtggcccttgtctgaggcttcacaacagtcatccctttcctgccagccccagaacttggctgttacctggttttccaacctcagctgactccatgggtctaatatcccaaggtacctcagccaaatgcagcatacacatcctctctggaccaggcttggagaatttggctttcccttggctgtgtttgtaaagtatggttgttcctacctggtctctgcatctttaataaagtccatcattggatatgaagatgctgtgcctgggtgacctggttgaggggcaggtgggctcagtggcagcaaagacatctgtaggctctgattgggctgagcaagagctaggggtcaaaggcagtggatgctggaggggcagcgaggggcttccctgcacagccaggagtttgaggggcctgaaggcacacacaccagccatcgatcttaacctgctcacttctagtacccatcagctcacttcactccttttgatgatgaagcagagatgagactagtccagcagaaaccaggacaggaagccccacaatgccagccatgcccctccattatgatccccctggctcagcgttcaggtggacagtctcaggtgtggtcacatggggatgaagggagcagacaagttagggagccaagctgacccaagccctgacattctgttcttcctcatgattagcccggttgtcaaactcatcctggccctcaaattccagccgtgagtcagcctatgaaagccccaaggcaagtttatgattcacctgagtgtagctcatcttctctctggataatcctcagatgacccccacccagccagggggagctgcctttatcatcccatgggcaggattagccctgcacatccaaccaccatttatttgtcgaacctgtatttgttcacctgtgaaacgggtgaaacggggaccccaataccttcttcacggagtggggaaggtagaggagccaaccctcaaaagcacccaggtcagggtctcagtccactgtaaacatcccccaaccctggtagcaatcatgcctttgcattgccttctctttccggctgtcttctagctcatcacttccaggtgtgcttcatgaaacaaatctcatgagatattcacacagaaaaatctgtaacaaaaaattgggaaaattgcataatattcctttcttgaagagttagtctaactttacttgattctgcttgactcaaacttgtttggccatagaacctttttcttgggcataacatttattaataactggggtgtcaggagatgggagccagctgacatgcttcttctccaaagccttaacccagaaggtatgcctagtggcatctgggtagatctggccagctggggaggctgggttttgtggatgcaggttttccccactctagtcctaagctgtaggcatctttctcccatgcctatctcttgagtattctgacacgctaactccctggggctttagctcccagcacctgggcagattaggctgttcccttgcggagaaaggtgagaatttaaacttggagccacccagacaagcttaaccagagccccttgctttgtacaactcaggggttaatgcagtgtcacagcccaacccaggtcatgcctactgagactgatgtttgtggcctgcccatagccccttagcatttattgttgcaggaggtgcacactggcattccattgtaagcatttgtgactctgcaagagatatttttctctgtttctggggaatgctggacgtgcagacaattaatgcccctgggaggagccctcacccactacctgatggggtgtattagtttcctgtggctgctataacaaaatatcacagacatgatggcttaaaacaacaaaaatttattctctctaagtctggaggacagaaatccaaaatcaatattactgggcagaaagcaagatattagaaggaccatgctccacctggaggctctaggggaaagtctgatccttgcctcttctagcttctggtggctgctggcattccttgactcatggccacatcactccaatctctgcctccgtggtcatgttgccttctcccttctgtttgtgtcaaattttgctccgcttccctcttataaggatacttgtgattgcatttagggtccacctggataattcaggaaaattttcacatctcaaagtccttaattacatctgtaaaatcctttttttttttttttttttttttgccatataaggtcacattcgctggttctagggatcagaatatgatatcattggaggccattgtccagcctgatatgtaaaaggttggagggtaaatactccaatttccttgcctcttgggtaaggtaacaccgagagctgttctacactctcctctctcctaaaattcctcagagagattgagcctcagttgtccatggcaacaaactactcagcaacacactctgttgcttttctttccttcctgtctcacttctccactcttctaactgttgattcctgggattgcctctaaataaactacttggccttgaatcctcctctcagggtctgcttctggggaacccagcctaagaaacccatctatcaccaaccatgcacagcaaaggcaatcactttaatcgattaccctttggattcacaaagtctgggtggatgtgccctgtagacacaatgtttgcagttgtgagtgaggtagctgggccagcaaccccccagactacagtgttgtaaccacctcctctcaaagaagatttaatccagcagagggatgtcttcccatctgtgtctatcttgacatccacagtgaagcagaaatcttgatgggacgtgaagaacaccatggtcaccacagtcttttttgattcagagatttgaccttctccagactttggagaaagagaagccctggttaagccaaacagcttacaggggctgctaaatctgatgactgcttagcagaaaaaaatatcacacggtggaaggacatagaaccgaatgaatgtccagaggtgctgtccaggagccagggactagagtcaaaaaccttagaagtctacctcatgttctgttgtactgcagctgagctggcactcaaaccataagatgctatccttcccactcttccctcccctttccaaaggcagaagagcctcaccctggggtcacaggcaccacaggcccatggaaagtactgccagactactggaatattcccttaaggcccaagggctcttcagtcagcttgtgatgaatgctgcctggcctaggacttgaccttcagggcagtggactcctctctggtccagggcaggtccagaaatgccatccaagagccaagtcttggaatcggggaccccaacagcctgcttggtgctctacccaccctgtggctgagctggttcctgaagtgcaagacaaagtcccctccctttacttttccctctgcttttctcaagcaggagttaaggacgctcgatagccaccacagctggcaatgtgctgagtctcatctgaagccagcaagtcttggattcccacccaaggccctcagtgtagtacctgggtattgctgctggctattcagggccaaagggctcttcagctggtagttattgaatcctcccaggactgggttcttcccttcaaggcagtgggttcccatatggccctgggtatgtctagacatattgtctgggagctagggcctggaaagggggcctcattgactctgataggtgtcctgtcctgctgtggctgagctggtatccaacatgcaaaacgaagtcctccccacttttccctctcctctcctcaagtggaaggaagggtgtcttttggatccacaagctctgtagcctggggttaggggaggagtgatgccagtactccctcaaccaccctggctagtgtctcagtaggtcatatactcacccagtccactggctctgggcccagttcagcactaggactcacctaagagttgtagtccttgtggcctagactgcccttccaatttagggccccagagcactttagcctgcagtggcgaggcttgtggaaactcaagttgggatcactgggattggcaatacatttctggctagggctggtttagatgctccctctgtgggtggggtcagctaagtttggatccatttttctttctgctataatagggcagcactgaattcaatgtctcacaattgctgtgatctccctctccccagtgcacagtgagattctccataccacactgtcactgctggcggttgggaaaggggtggcatcaatgatttaaaactgtttttcttacctctttagggccttcatcagcgatgtgaaattcaaaccaggtactgtgagtgctcacttagtgtttggttcgtatgaaggtgcttttttttttttttttttttgtatatagttgttaaattggtgtccttttggggtgggaggagacaatcggtggagtcttctattccactatcttgctcttgtctatttttgtttttgttattattgtttgtctgtttatttgttaggctgtcacaatcttgggtcaagcctcatttcttttccctgggcctgttgtctttgtgactctaggctctcctctcttctgaacttctatcatagatctggccatgacaggacactcacgaaagtcctttaagtgatcctcactcttcaggacaaagttctgattcgccgtgagacttatgttgatctgtccgggcctacccctctgcctctccatgctcaactttccacctgcttgtgtgttcccctaaccttcgaagttctctgcaccagctgccatgctcaaacacaatacctgtttataactatgtgtttttgaacatgtcatttccttttcttggaataaatggccttacggactgagaaactttcatttgcttgccaaggcccacattggcagttatctacccttccctgttgctctcattgcagtttgtatatatcctaggaatacactttggacagaaattatccatggattccagatgtctggcacctcctggtcctttgagttctggataagctcggttggtgctcccattttatatctaaaatttaccccaaaccctcccaaattctctgcctcttcttccaagtgttatattttcagtgactcctccaccttgggcctactgccatcagaatttaagtcttgattaagactggaaaactcagtcttttctttgaggtccatgaacaacaccacatcttccaagcatttatgagtgcaccgagtgtagtagaactcaagtgaagatgtattttggggatgagaggttagcaccacagggaaatagtctcttccctaatagcctccaatccactctaccatcagggcttcagtcagtatcactgggcaccattttttctagctttttgtcttcttccatctcaccattttccctctttaaacctccctgccccctcttctcagtaacaaatattcccctccttgttatatgcagagaagtttgcttgttttcctttgttgactccttgcctcagtggcttattgaggcatttctatcaagacagtctgcccctactcccaggggtattctggtactagctattaagagatactcacctctgttactcttgggtgcttgtctatcatcaccaagggcctaggaagccctggaggatagagaagatgaagagaactagcttcattcttgtgggaatagttgtaaggatgaaatgcaatcttttcctcctccttcttcttattagatattgttattgttacttttcactcatcttcatattgactgggttgatcacacttgccactgtgtagaaccagctgttactgaggctggatgttcctctggcttttgtggccttgctcactgacaacttaccctcaagaaggggatcagagagccaagatgacatgtgtttgggagcagaaagctggacatgacatctctggctgtgcaggatttggaaagaccctgtcaacataggcactgccaggagctattttgtcttgtcctgactcagcccatacatgacaatctcccttgctcccttcgtttgcctgacacttctgagctccatctcagtgccacacttttcttgtgatcttcctctccagcacctctgccctgagtcaggcattaatagctcttggaagtgggtaacatttttattcccattttagagatagagaaactgaggcctagagatgttagtgaagagctgagacaaacccaggcagtttagctctgcattctcttcataaaaggtaagacaggctgtaataaaatggactgggcctttggccccgaggaaggaagagttgttcacatttgaccactggggccaaatgtgtctgagtagaggaaaaccccaggtgttgtggtggtcactgccacaggtgagtcagttggcagagctgtatttggacccaattctctccactccttgtcctatactctttctaatacaccaacctgttttactttttattaggccatccctggataaagtggagggacttgcctggggtcccaagattttgctgtgagaggtgagattagagtagagatctcctgcatcctggtctaaaactctttccaccacattgagctgcctctgcccaaggctgcgcccatctctttgcctgattttcattctctgcttctgcctcccctataagggcgctgcaaagactcaccaagacctttccaatccagttgccatgactgttagtgttatgcacctacagactttgtaattcaggttgcagagaagtcagtgtttgtctaacttttggggctgaagaggacactgagggcttgtctggggcatggggctgattggtcctatccaatcattgcctacttgtcctttgccccatctcacaaatatgtaatcaagtgataggtcaggctgttatctgattatgtttgttaagacccagataatgatttctgtttctttctctaccttcacacacacacacacacacacacaaacacactctctctctctctctctctctcactcactcacttctaggcaccaaagggctgtaggctttgggggaagacccatgctttagttctgggccttccaatatgatctgggattttggagggtgggcgacagggaggctgagctgtcactttgaattgcaaagcgtctattcataatgcataaagaggcccccgcaagtggccatagcctcctgtcgtcctgcagctcagggaaattagacagcttcagagccccttatgaaaatgcaatgtattaccgctgctttttcactagtaaattatgcattcgagagtgacaaattccaagatgccgcctttattaggaactcagtgcggggtgggtggacagtgctggctgccaagcttgcgacagaatgtttaataactttttctgactgtgcttcccggaggtggtgtttataatacgtatttccctcctctctcattttatcaaaacaccgatgctgagcttattgctctatttatgcatttggaacctcttcctgggtcaaagagcatttgaatgacaaaagcaacgacagagaccgtttttttaaccaatctgtctcacatgcctgtgaccttggtgttcttggttttttaaagatccatccatttggaggagtcagctgcttcctgaacttcaggccttgaggcaggagacagcgtgtaccatctcctgccattctgttggtaagtagagacctgtgatggtacccaggattcaaaagtcatcttccccggcgggaggcaagggaggcttatggagaacctcttaaagatattgtgagcattctactcattacttagggaaagacagcgggtgttggtccaactctggcttttgtgccaggtaggagttggtcctgaggccgcccatctgaccatactggacctgttttaaggtttttctctaaaaaaattttagatttgtcaatctgtgctcctgcaggggatgctatgtccaaatgtcccaggatttgtttttttctgtctttcctgagacattccctgcccagctacccaaggaatccttcaaacgagcaaatctgaccatatcttctatggtcagattaaaatcttccatggctccctattgcttatgggacaaaatcaaaattcctgagtctggtctaaaaggtgtttgatgatcttgacctgctgactttgccagccttcttgtcagactctcgtgtcatgctccgcctagactatgagcctgctatttcatactatgtagctttgtaagtcccagaaaatgctgggctctgactcttttataactttacatatactgttccatctgcctggaatgccttctacttgtctgtccagcaaattctcactcatctcttaaggcccagcttcagtgccgcctcctatcataagtcttccttgatttcccaggcagaattaagtccctcttaccccatctacccattgtgtttgtacatacattcattatagcaataatcatattagatttcaatgattggcttgtctttctccacactttatttttaatagaacacctaggttttagttaatgctaaacaaacatttgttggttgtctgtgtggcatcttgggttgcctgacagactcttggccaaatctgttcatgcatccaacacatacatactgaacaacttttgcagaccaggcactgctgggcctgaccttctggttccattactaacatgttagcagtgtcactttgagcaagttacttaacctctctgtgcctcagttttctcatctgtaaaatgggaataatgcttagcacttaatttttggcaagctagtgagaattaaatgggatgatgcctgtccagtgtatgagggatagcctctattagcccaggactggcacactggaagcacataataaatgctagctgcaataataataataataataataataataataatagtgctattattatattatatgcttatataggatctatttacaataatataaatataattattattcatgttacttgctctccttgaattgactgggcctccaactttccctggctgccttgccctacacttcgcagatgggacatggatcattttaattagattttattgggctgttatatgggtcataattgaggccattattcattttcatggggctgctgacacagcctcagtttagacatgatgctatcttgacgagacaagtccccatctcaaaggatccctatttgaggggctggagctgccacaggaaaagagtccttccgaggccccaaacacagattctgaagagattaatgccaggagtgttcgtcagagaagaggagatttgtgggcgacagtggcacccttctgtgtggttgttggggccacccctggggagtggggcattcatccacttggctgtgtgttccactctcaccccaggatctccagtgctctggacagtgtctggcactgagcagacactgggaaaatgtttgctgagtgaaagccacacttgcaggtgctcaggaaggtgaaagcagtgagtgtggcccagcacacaggcctggggcagcctcacaggttccagctcctgattgtgtgctgtggactgtcccttggttcagagccatgggacgcgctcgtgtagccccagtcaggggctcgtcgagggattggtattggggaaaagtcagtgtaggactatagctgggcctttcccatgagcctcaactgtctggatcagtgtgttcttaggcttggcctagatgggttattgttcaggaaagcttcactcacctccctgtgcagagtggtggagtcatatttccctgccccattgatgttggtcttgcctatgtgtttgctcatgtgacagtgaaacattagtagacttcaaacaagaagaagctgtgaacacacttgtgctatctggctcatgccctcctgcatgcacactggcgaactgctgtcatgataagcatatccgaattagtcccagcatgaccatgcatggaacagacctgaaccttgtttgtggtctgaagccaattccagccaactttcagtgggaggcaaagccaatcccttgaccccagcctagatgagctgagcccagtccgcctacagacccaggagcatgagaaccagtacttgtggtgggaagtcattgagttttggcatgcctgttgtgcagcattagcgtagcagtagctgaccaatacagagccccagagcagctccagtggaatgtgtttcatatattgagtttctatataagcatgtttgaaataagaatttgattgttgaaaacagattgaaagcctctacaacagtggttttcaactggaggcaattttgttctccagcgtacatttggcaatgtctggagacacttttggttgtcacaactgggtgggggtcggtgggagggatggtaggatagtggcatctaatggtagaggccagggatgtgctaaacatcagaatgtaccagacaatcccccggagtaaagaattatctggcttaaaatgtcagcagtgctgaggttgagaaaccctgatctaaaatctaagatcatttgaatctttaccaccaaacatctaccctccctccttccctctctgtctccctttcttctttcattcttccctcctctcctcttttcttttttttcccctccctccttctctttctttcctacctcctcccttctaaacaagatagatatatgcccaggccctcagggaatttatcttgagaggaacatctcagacaatataggcataaaccagtgaagtaatgatgacaaatgctatgcaggatgcggtaaggaagaattacaggggggaccacccttggatggggtgatcagggaaggcctctctgagcagctgacagatgtgagggtcagaaggagaaggaggaatcagccttggaagaactaacagaaaaatgttcctggctttgggaacagcaaatgcagagacattgagatgagtgtgaacttggtgtgttcaggaagcagagggagcccctgtctggtgcaagaaaagtgagggccaaccctgccctgcctggcatggggctggagtttgctgagcaattgatacaatccatgtcagctctttggaattcccagaaattcctgtagactccagagtcttgggggctcaagagggttcaaacttaaagctaagaaatcacctcaatgccatgttcaatctattacttacaggcacagggctggaaatggattggcattcaaagtaatggaatggaatgtatttatttgaacatcaaaatccttggtggattaaaatgtgctgggaatgtggagcatgacctcaccgtgacacgtgcacctgctcagctgcattgagatacagggccctgcaaaatggcttgttttctcctaacttccaccctggtcccttccaatacaggctccacaggaaagtcaggacacaaaggaatcattgcactccactctgctctcaggataaaatccatactacttcttcttttttttttttctgagacggagtcttgctctgtcgcccaggctggagtgcactggcacgatctcagctcactgcaacctccgcctcccgggttcaagcaattctcctgcctcagcttcctgagtagctgggattacaggcgcccgccaccacgcccagataatttttgtatttttagtagagttggggtttcaccatgttggtcaggctggtctcaaacccctgacctcgtgttccacctgcctcggcctcccaaagtgttgtgattacaggcatgagccaaaaatccacacttcttgataaggcctacgaagccccccatggtttgatctttgcccagccctcccacctgtctcatcctatcccacttgctctggggacctcagggatgtgcccatacctttcctgcatcacaaggatcttcttatggaacagacttctcatagccctcaacaggaaccagcttggactctgggcttcaggactgtgagaatacaaatttccattgttgaagccacccagtctgtagaattttgctagggcagccctagggcattaatacacacaggatggaagggatgaatttgtcttgaggggttgtggaaggaggtatatgggtgggaagtgggctggggctgtaggtgactgagggtgaggcacttacactaactcctattttggccctgggtgaggctgtgatggaagctgtggttggtgctggcctgggcctttctatgtgtgtgtgtgtgtgtgtgtgtgtgtgtgtgtgcgcgcgcgtgtgtgtgtgtgttttggggatgcagggtgtggcaggcaggaaggagagcttgagccagaggcataatgaggacatggagaagctgagctgtggagccagcaggaccttttctcctggaagagaaaaatgaaacggctggttggctgcgagttgttcagctgagtccttgtccctaattaccacccagaccaagcctctgggcagcatcatcctggcccatctgcagcttctaagatggtcaggatccaagccaggtgccggtgtgtgtgctggtcctcatggccagtgagcagcgaggggactttaattaaagaactaattactctgactctctacgggaacatctgcagccccccagccagtctggagcaggactccctctaatctgggctttcagagcaatgcctgagtgtgtatgtgtgtgtgtgtgtgtgtgtgtgtgcgcgcgcgtgtgcgtgcgtgcgtgtgcatgtccaggatatgtgcgtgtctgtgcatgttggtatgtgtgcatgcacttggacatgtgctttgtgtgccctgtgcatgtatgtgcacatgtattggtgagtgaccatgtatatagcttgcatttctatttgtgcatctctgtgtgtgcaggtgggaacatgtgcacacgtgcgtcatcatggtcatgtgtatgtatgtgggcaagggggtaaatacacatatgtacccaaatggtgtgggtgtgtgcaagttcttatgatttttttcctttcctatgattgaagcttcagcgactctatgggttgcatgtgtatgtgtccctggtcattctgcaactgtgagtgtgtgcagtgtgtgtgaacatggctctataaacagggccccagccgcaggtaacatctgtgtttgcactgggcttttggaagctcttcccaaaggaggggagaattcggagattttagggagcaggtgaaggaaggctggtctgtgaggtggatggtttgcagtgaggggttcagctctgccctgatgccctgcttagtcatgttggaccaaggtgggaggttgttctagacagactgtccagggattgagtgggaggtttggctctgggcaggggtgaatagttccaggtggacagagtaagccttccaagctgaacagtatgcttcccactgtgagctccggtctccttgacaacacagagtcagggctgggccctggggaaagggatgtgcatctccgtgtgcataccacgaggggaactccgggacgctctcctggtgggaactcagattgttttacgaaggggtttggagtgtggggagaagaaaattaaaaaggtctctttcaactgcaaaacaaaattcataagttttaaacttcaggtaagttcagggtctgagcctggtttgctctcagaggtagcatgatctgtttgaatccctgaagcatgaacacaagaggtttggaggaggctcagagtggacataaagagattggaggggctggggcaggcccctgaggaccatgggaaactatgggtgaccccttcatgactaaggagaggagatgggctggtgtgcctggatctgggctggatccttatggagcatgaatgtagggacagagctctctggacagtgggcaggagtggggaagttggcacatggaaaatgctgaccagctgaatcttgtgtccttccttctctctctcccattattttgattatttcacaaggaatctgaagcttcccctccatgccccactggcaaccaagggtgcagtgccagaaaaaaacagatatttccccagaagtcctgggtcaagtatttccttgcaagctcattaaatcaccttttgctttgattgttcaactggtagtgtcgggacctgtgaatggcacacagctcatagctccaagtgctcctggagccacccgtccctgccagctcccttggggctgggaagcaggggacatgccatgggccttgctgtctagaggactgaagggtcattgaccaaaataaccccttaagttgtcctaacctgctagagaaatgcttctggttagacagagcaattgttgaaacactggcctacgttttctactctttaagagataccttccatgaattaacttattaataggagtcataataaagacaataataatattcagggccaccagtagcccaggtggcagctctgagatttagaacaaggcaccatctcaaggcaaataggtgatagcaagttgtcccctttgatggccattgagaatgaggcactccttcctctgaactgaggcagccccactgaggagcctggcgaggaaggggagctcaggctggactccagctgcacttggctcccccttggctaggtgccttggtacaagggtcaacctacacagcagtgcatgacaaccctgggtgatagctagcgttctgcaagtgcttactgtgtgcaggcactatgctaagagtggacatggattatcttattctacccccacaacagctgcacaacctgggaaacatcaaccccgtgttgcagagaagggaggcttcttctctgaggcttcgggaggttctgcatgctgttggaggccacacagtttttaagtgcagcatttgaacctaggcagtctgtctcagagtccaagctcttagccacaaagttaaaggtagggcctggggcaggtaaaaggatgggaggagataagttctcagggagctccaggttggtgggtagacagaagcatgagagcccagtggactctgccagtgccctgtccatgcatcctcccccaattctgcttcctgctgatggaatcttactctctgttcaactgaggctttcccttggattgcatgcagggcagaccataagcgctgaaggttgatgccccagccaatgaagacaggaattatcctttattgggatagctctgaggcatattctaccccgtttcctaggggtttccagtggattgaagccaagttgcctacagggttccccagctcatgaacacaccccatactggctgtcttcatttcctatatcactctcctacacctggtgccttacctggacccacctcctaaatatactgctgttctcagatcctggtctcagggtctgcttctgggggatcctggcctaagacgggggtcctatgaccacccttcctaagcccatagccagccttccctacccagaagacaggagctagaggagtctaaggaggaaaaggagtattatggaaaatctccgtgcctagagcagtgcagtccagctcagaggggttcatttcagcagaggtttccaggggcagggccaacacatctgagaggagtgtgtgcacccgtgtatgtgtgcatgcacagacactatgcatgcacactatggactcaccacacaccacacacagtttccaggcaccaagcaaggttcagccttgcttagcctcatggctctgtggactctagattctcaaacatgaagctaagaggcctccttggggacaaggctgtgcagcagggaagcaaatcaggtgagtggcaggagtgtcctggtgactgcagccacagcaagtggggtgcatgcaatgcagtgcattgggatcaagtacacctgtgttttgttttgttttgcttttttgagatggagtattgctcgtcaccaggctggagtgcagcggtgcgatcttggctcactgcaacctctgactccctggttcaagcgattctcctgcctcagtctcctgagtagctgggactacaggcatgctccatcacacccagctaatttttgtatttttagtagagacggggtttcatcgtgttggccaggatggtcttgatctcctgacctcatgatccgcctgccttgggctcccaaagtgctgggcttataggcgtgagccaatgcacctggctgctacacctgtatttgaatcccagccctgcctcgcagcactatgtgacctcaagaaagttactgctcctctctggccctcccctgcctctgagactctggcccctttggcttctgcgtctgccctgacacatgacctccttgttggcatcccccacaacacccacataccaagaataaggagatgggtccattctacccaaattttggatgctggggagaggatcacatccttcagccatggagcaaacatcagcttccctcttccccttcttcctccggtctcaattcctctcccttgaataggacaagcagttcagctcccatagactcaagtaaccaaccccatcacagagcttagctgaacaaagctgggcagggctgcctcttgagccagcctccttagaagcctgctgggcttagaaagagcaaaactgtcatcttcttattcccacagcggatactgggctttcactaacattttacataaacagggtttagtatctgcaaaagatgggaaaaccacttgagtaaagtaaactgtaaggacgttgccagttccatagagctttgcaaattgctcttcaattttaaacagctcgttaaaatgcaggctcacctggtccccacaggaatctggtaaggtgggtatgatgattatgattgtcccattagctaagtcatcattgaaaagtgagtgatgttcccattttacagctgagatatagggtcacagagatgttatgcacctgtcttattgatgagacagaatgttttttgttataagtaacaaaaacctcaatgaaaatagtgttaaataatgaggacgattcattagcttggatatagaagactctggatgtaaagtggttctagggttggtcaatacagtagctacctactcagtgacttggggtcttgtcttgtcttttctcctttccctttccctttccctttcctttctttcttgatagagtctcaccctatcacccaggctggagtgcaatggcatgatctcggctcactgaaacctcctagcttcaagcgattctcctgcctcagcctcccaagtagctgggactacaggtgcatgctgccacacccagcttttttttttttttttgtaattttttagtagagacagggtttcactgtgttgcccaggctggtcttgaactcctgagctcaggcaatccacctgccttggcttcccaaagtactaggattacagacatgagccacgatgcctggcagatctttccatctttcttcaggacattcccactctgagaagcttcccatttgcaggtaggtttgaagctgtttgtcgttcatgtgttggacattgtgccaaggtagtttcatttacctactttatggaggaggatatggaagcccgaggcactgacctgtggtatccccaggatttgtggcaggacttctcactcgaattccagggctccccttcctcctccatgccaccaggcgctacctccatggaaaaggcaatgccacagttttgagctggttaaggaagatacctcctctgctccctccttcaccatcccccagtgcagagatggagcaccttggttccagctcaagaggggagagggggtagggccacggctgggggacaatttagggctgattcacagtgactatgaactaaggcctgactgagagggtatctgtgaaggacactgatcatctctgtgcttcgctcccaatggtgtctatttataaaatgttttagggagtcattgaatcttcctaaggggcagtagataaagcataaccttggagcagggagatctgctgtgttagtttaggagacgctggctgctgtaacagggaaactctgacatcccagggactcggttcaacaaagcgtatttcttgcttacagaaagtctacttggtggcagggttgagggtgggtgggggttttctgttccacaaagccattcaggcatccaggctgacagagactctatgccttcaacatgtggcttccaaggtccctctggatttcataagctagatgcgacaggacagagcatgaagggctggtgcggggcacccttgggagtggtgcacattattcctcttgattcactggctggaactcagcctcatagctatgtaatctcaaggagagtgggaaattttgtgcctaggaagaagaggaaatggatttggagagccacatcagtctctgccacacttggttttgaatctagaccttgccacacactatttgtgggaccttagcttccttaacatgtctgagcctcagtttcctcattaaagggcaaatggtgataatctcctaggaggtatgatgttgggagggtttcttgagttttttctccaacactcccatgcagtcgtggttcttacctgcagagctccagcctctatgtacaattgtccacatacttgtcaacttccttggtaataactcctctcctggagggcaaactccaccagaataggggccacactgctctcaatcagagctgcagccctaacaactggcctggcgcccagcacttagtaggcattcaataaatacatgtcggggaaatgaatggacggataagttaatatgaacacatatgtgctaagatttactcctttaaaaattcttcctcaataaatattcgcacctctatgttccatcatggtgtggtgagggggagggaggggggaagaagacgaggaggaggaggggcacctttctcccacccctactggagctcaaactataaatagctccagttggaatctgactgcagattcctccagcaaagtcagcatccccaggacctctcatcctggatggggaccgggagtgcttcctcattaatcacagctctttaattaacagctctgagcctggaacaaaaggtgcttaccgggagaacgccagcgggccctgaactctggccgcctgtttttatttggaggacctggcgccttggggagcaggcatggcatggctcagtgctgagcctggcaggggatggggtttggagggcgagcagctggcaggccggctgcctgtctccaccttggacatctccacacagagctgactcgacttcgagcaggttgctggcagctctgtcctcctcaggctgatgctgatgtcattggtctggggtggggctggacagtgaagttgtcacgttccccaggtggctctaatgtgcacagtttgaaaaacactgctccagggatggcaggcttggcagaaggcactgagatgggtccaaaggcctaactgagtgacccagagatggacacttacccaaggcatgcctaatgcccaggcagatcaaaggcccactccctcctcttctccccgttggcggatgcagcaggaatggaacctgcctttccttctcccatcatgcctcctggagatgatcagaggagagccagaccacagaagcaggacttcagccaggggctgggtgggaggcttggaaggcaggaggaagcacacacagcttggcactggaagcagtggccctagggctcctgctgagccccaggtgtaatatcaagttgatgcaaaagtcgttgtggtttttcctattgctttcaatgataaaaaccgcaatctgacaaaaggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaacagttagaatggcaatcattaaaaagtcaggaaacaacaggtgctggagaggatgtggagaaataggaacacttttacactgttggtgggaccgtaaactagttcaaccattgtggaagtcagtgtggcgattcctcagggatctagaactggaaataccatttgacccagccatcccattactgggtatatacccaaaggactatgaatcatgctgctataaagacacatgcacacgtatgtttattgcagcattattcacaatagcaaagacttggaaccaaccctaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaataacgagatcacatggacacaggaaggggaatatcacactctggggcctgttgtgggttgtggggagggatagcattgggagatatacctaatgctagatgacgagttagtgggtgcagcgcaccagcatggcacatgtatacatatgtaactaacctgcacaatgtgcacatgtaccctaaaacttaaagtatttaaaaaaaaaaagtctaggagaaaaccaatcaaatggtcaacatggatgatggcatataagtgttttaacttttctttaactttttgcattaaaattttttctatattgaataagcaaaaaaaaaaaaaaaaaaaccgcaatgggctgggcgcagtggctcacgcctgtaatctcagcactttgggaggccgagacaggcagatcatgaggtcaggagatcaagaccatcctggctaatacggtgaaaccccatcactactaaaaatacaaaaaattagctggacatggtggcacatgcctgtagtcccagctacttgggaagctgaggcaggagaatcgcttgaatctgggaggcagaggttgcagtgagctgagattgtgccactgcactccagcctgggcgacagagaaagactccatctcaaaaaaaaaaaaaacaacaaaaaaaaacccaaacaacaacaacaacaaaaaaaaaccacataaaaaaccacaaaccacagtgacttttgcaccaaccttataattcttcctaacagatctctaatgttcttttcaaatttgtctcttcacttcttctcttgtactgtgaccactgttgaagggctccctacagcagacctggctcattacagagttctgttagcatgccctctgaaaggcagtgtcttcatctataacatggggacattatgcttgacagattcccagtgtttgcatgtggtaggtattcagaaaattcttgtgtaaactctaaagttcaaatcaaagatggcaaagagttttcattccgtatgccagccttcatgtgaatggccgcggtcacctggaaaggaatttgaggccaaactggggctcagtaaaaaggatgcgggagttgattagtgatgtctctcaggggtgcaggagcaggaagtgatggccagaattgcacgactttgccatccctggtcttggcgtaaactttatgaaggtaaggattgagtctttcaaaagttcacttttgtgtcctttgcgtttagtaaagaatctggtgtacatgaagtgctcaaatgtttgtggaaagaagaaatctgtccattgttttttctaattattattttcttgactgttcctagtccacccttcactgggtcttttttggagtttggattcctgtctcctttcctagagtgatggtgtcaaagtccctaagctgtttttggaagggggctagtgtgattgagttgttggttatgcagttaggcaggcctgtgcccacgtcctgcaggcaccactgcatcctggctgtgtggtgttgggcaaggcatttctatttgctgagcctcatttgttttttatatcatatgggaataatattggattggtgcaaaagtaattgcggtaattttgcaaatggcaaaacccacaattacttttgcaccaaccttaatacgaacttcctcacatcttatcctgatgattacatgattaaatgaatctaaaatgcccagaaaatgcaagtgctgagagttggtttgcttctgaatttcaaagtccaaagtttatttcatttttttccccctccctttccgtaggcaactgcagtggggttaaagcatgaatttttatgttccctttctctgggcctagttttgtcactctgaagtcctcatttttatattctcaaatccctaattcttcccctccctattctctgccctgccacccacctgccaattaatcaattgtttcagttttctggctacatcttagtctagccatacaagctctctccttaggcttttattttccaaaaccaaggatggcatccagtatgatggcccccgctgctgcctctgcccagggtgctgactttctccaaactctcaagcaggggttaagtattaagaggtcatccctgggagtaacctgaatatttgggacttttttttttttttccccaaaatggtattttccccagtctacttaagagcatattaagtgtacatattcccagatctcatctaagacatagggaatcggaccctgggggagtggagactgggtacctgtgagcttcaagcacccaagtgaccctgtttcactctgagttttgacagtaactagagaatgttcctaagagagaacctcatttaaacagtttcccaggatgccctggcatttctctttgcatgctccagcccatttagctctttttacagtggctttcaatatggacttcacactagatcccagatcaattatgccaggagttttgggggtggagccttctaaaagtcctccaggtgatttgaatggggatccagggctgagagccatgaaattcctgagattccagctcctgaggaggaaggcaatccttggacttcttattgcaagaggagtagaattctctttgctctctgctcttacgtcctcatgattggggcagatcctagaagcctggttgcctcgtgtatgcagtagacacagttactatgtattaaaaccacttgttactcatggacttggccctcaattcttcctctcacctctgtaaaattggtctagagcagtgataattttgcccatctttttctgtcatgcacattttagcacccttatttctctgttctcccagttgatgtggcaggcaggagtgcagtagtgcaccaagattcaggctggacaagagaggaatggagtgaccctcctaggacaggctcctagcacaccgctggtctcccccttccccaggaaattaatccttgttctggcattactaccaccagagccctctagactctatgttagtgtcttggagggggagcttactatctctttgggcagcttactccatatttgagaagttttggggaccaaattcatcactacccctcttggttctcagtaacaacagaacaattcttcacccagctaattctcagacagatctcagcttaaatgctgcattttcaggagcctccctgaccactccattttatttggtaccccccactttctgctacttactacactaagcttgttatctttattacaaataccacaatcgatgttatgtttgtttgcctgtttatcacctgtctttcccaccagactgtaagctttactaagagcagggaccaagcctgctttattcacatgattcataagggtcctagcaagaaatagatgtcacacttgaattctgtagtttgagtttaataaagggactttttataagggtataggctgggcatggtagctcacatctataatcccagcactttgggaggtcaaaggaggagtattacttgagcccaggagttcaagaccagcctgggtaacaaagcaagaccccatctctacaaaaaataaaaaaaataatcagccaggtgtggtgtcttacgcctctggtcacagctacttgggaggctaaggtgggaggatcacttaagcctgggaggtcgaggctgcagtgagccatgatggcaccactgcactccagcatgggtgacagagagaaaccctgtctcaaaacaaacaataaaactccccccaaacccacaagggtgtaggcaggcttagggtaatccacaagggacagtatattacccaggactagccacaccagaaagctgtgactaacccaataactgagggtttttgcattcccaaaggcgtggtactggagccctggctggagcctttggttgaggccaccagcagcaacttgacaaataccttgacctcgctctcctcttgccttctgatcttctattgtctgagcctggtcggaagtgagggagtaagggagtccattgatatgttttatcaggtgaacattttggggtacagagcgggatggagagggcacccatggatctgaaggggccgatgaaagatactccacatttgctgtcgtatgcacagatcctggcactgtatctggcacataataggtgcttattaaatgtttgttgaacaagtgaattcttattctatttgaagagagtagtcatgccatctggatctccaggttcagctctctgttcattctattaaccttcagataatgcatttttgtgacccctttccaccctggttgcctttttctgagtgcacttctgttagttatgtccctgtaaagtgtagtctaggtgtggtctcattggcacagagcagcaggaccctcccgctgtaatctctcttcataccgcctgagatcctgaaatcccagtatatttttgggaggacatgccatgatgtcttcttgctgtcaagtgaaacccctgcatacttgcatgagctgctgaacatgttgattgaattccaggatatagatctgctttgaacgttgtctgactagtgattataggatttgacctaaattaagattaacagtggcaaacaccacacatgcatacttccatggcagacattactaatctatcaaagccatgattttctgctacacctctgaatccttctcaacacatgctttaggcagtcagtaccaatctgttggaagtggcatatgaaataaaacctattgaccattcttgctgtaggctctctttggatttgagaaatgaaggatgggaatagaaactcaaatatcttaatgaggaaaaaactgtttctattgtctgctcagccactgagcacctaatagggtctatgtgaggcttaagcaagcatgtgagtgaagtacagagctcagcgccaggctcatggtaagtcctcacattgctgtggtttgaaaaggaaactgtatatccaacaagtagaacttctcaaactctttagcaggaaaggcaagccacactgtggggtcttgctgtacagaattgaaggagctccaggtgagagtaagcctataatttgtagggcagctggaaagtcaaggtgctggagccagaaggcaagatgaaactgagacagaatccttaggtgggacctggagtgagttgtgcagccggagacccgccatgctgatgaatgcttcaggcaccagcttactccctgagttttggcctgtcctagacatccaacatgcttacacaagctgacagagaagcttctgcctccatttctcttcctggagcccagcttatttgtcaggggtccagactttggacttttgcttggtagggtggattttattactaaaccttcagttgctggtctgtgctctatcctccctcacctggcacatttctagttatcattaggccagcactagttatcactaggctggctctcataagaaggcgtatcttgaatgacatgtacattaccaatagatatgatgtgagccacaaatgtgagtcacttaatgtacttcagaatgttctagtagtcatatttaaaaaagcaaagagaaacagttgaaattaatttagataatatattttatttaatccaaatgttcaaaatctaatcatttcaacatatgatcagtataaaatgactaatgagatattttgcattcttttttttgtagcaagacattgaaattaggagtacatttttcacctgcagctcatttcaatttgcatgaaccacacttccagtgctcaatagccacatgtggctggtggccactgtgttacacagcacaggtttatgtcctaggcaaatcctacattctcagggatgtccccaagcctgacctatttgctccttccttgggctctccttatcaaaacagttatcatactttactgttattgaaagtttactatttctcctcttctctggagaatacattttatcttattttttgaggcaggatttcactcctgtcacataggctggagtgcagtggcatgatcttggttcactgcaacctccgcctcccaagctcaagtgattctcctgcctcagcctcccaagttgctggggttacaggtgcacaccattgcacccggctaatttttgtattttttttgtaaagacaggattttgccatgttgcccaggctggtcttgaactcctgggctcaagcaatctgcctgcctttgcctcccaaagttctgagattataggcgtgaaccattgtgcccagccaataatacattttataagggtagtgagcaaatgtgcttgtttatgcatctctctacctggcttgcctggcatatacaggagttctataaatccatgttgaataagtaaattaacagggccctctattctccagggaccccaccaccttttcttccttgcttccacccctgtccctgactcagtttctcagatcctggcacaccttacggcctccccatcccctctgcttgtctcatcctgaggcacctgacagccgggattattagtgggcagatcaggcaggggcctaatggacttgggcagcgctagtggggagccagcacagtacagggggcaggcagaggggcctggaatgacgaatggccctgcctgctggcccggggaggcgccacgcacatacttcccaccgatcggtgccagcaagtgatccagggacactgctaaatgccggctttaaatctcgcttaaagggccatcaagagcagcttttggccgtgagcatctttgccattattctttactaggcccttttaacgtaactgggaacagggcaatattttgttcatctgtagctattggaaagaggctcagcggagtttaatggctgagagctgggcagcaggcttatcctgggagggatctggggccagctgcggccagctctggggccttttggggtagggtgggatctggggtggttctttggtggctctgaggggctgggccctgtagcctgtgaggatgaaggctgacttcacctcctccccagagctggcctccatgctccttaggtggggtgcctggctggatacttccaggggcccctgctgcctcttggattcctgagcaaccaggagctgagagcaacagactcagcagtggcatgttgggggcaggcagctttgcattcccaaatcacatgctctttaagtctcaacagaaacagctttaaaaaaattccgacaactccttatagtccctggtccactccttccaggcacccttcagccctggcctctcagcctcaaattatctatgcaatgtgaaagcccccattacactgcttccaaagaagcagaggctcacagtcctttcttgggggagacacccttgtccatcaggtgtttgaactagtggactagcagccaaaggtctacatgatcacccaccagccagtgactcttacaaatatgaggcttcttggcaacccttaggcagggctgacatgttgtccaactcacgggagggcaccattcatatcaaggtctatgtgaatggcatcgcctgaatttgtgcagtgcacagcttgggcaaccacacgcagtagctctgtcttcagcctctagtgcgtctctactttggcatggtgttgatgtgggggtgaggggcctggctgtgtggttctcagaaagggtgatgatgggttagcctcccttgacagaggccactgctgtccttggtgtaggtctgagcctcttcctccacttcagaattctagaccagggattggcagactgtgcagttctattggtctgcagccatgccatacatatgtagttcatgtattgtctgtgactgctctcaaacagtagacaagtgaaagctacagtcgatcatagagccctcaaagcccagattatttactctctggccttttaagaaaaagtttgtcaacccatgttctagacagtggtgagaggaaaggagaaggcttctaaatgcttccttactggacatctttggagggcctgggggggggggggcttttattgattgctttaattaagcaggcctggatatatatacctcttttcttgctgtcactgacttagtggaagtaggagtgtcccaatatctttgttgtgtactatagctgacatccaatccaaggctgtgtgacctcagggccaacagagccgtgtgtgtgtgtgtgtgtgtgaccaagagagccgtcattcaagaactcattctgcaaatgtttattctacctgccgaatgccgggaaaccagatgctgtgtgtacagagacaagtaagacataggtccacaggtcctgacctggaggaggttatgggctagttaggaggaatgtgtgtacacagataactggaatatggtgtgaagagtattataaaacagaggtcctaagatgaactcttccatgaggctggttggggggatggggacaaatgagtcgggtcttgaagtagaagtagaagttttccaagtatatgaaagaggatgagggtatttcaaacacatggtcttagttctgatgtagtttcagcacctctgggactgagtgtgtaaatctggaaaacatttagaaaagttactgcgttgagtctaatgtctcttgtcctttatagtctcacagatattgcaaccctgtccttgtatacaaagacatttatcttcatttctctgtccaggcacagtctctaagtagataattacactggcaggcttgtacaaagatggacttggacacactcatgtcagccttgttcagttcattcccacccatgcctgccacacagctttgtacacacacctgagcctgcatgtgaatacacctgtggacactgagcagctggaatgtaaacatgcacacatatccctgtacacttgggtgttgtccttgatcttctgcctccagcgtatgtgatcacctgaacttcatcctctaccaccagtgataacctggctatggaactcaggcatgaagaatgttttgactaactcaaatgtgcctctccctagtttcttctttactcttatgccattccctctttctaacccacactccacttttggtgaggatatatggtttatatcctcaacaaaatatacatggtgctgtgacctggggacaaataactgggtgctctatttaggctgaagccaggtaactgaagtctcagagagctcactgttgtcaaggtgagaatctcgaaggctgggctactgacttgtcacatagccttgcttggttctaacagctccttcctggaattcaggtcatcaggaaactcgcaatccatcgagggaaggagtagatgaatatgaggaagctgagagattttagggctgtctcactcatccaggaatctgcatataatattcttctctgttttggcacatggaagccttagtgttttgctggtggtcccacactgaatagagtggatatgtccatagagtctacttatctcatgtacttccctactgtagattttattatacgcaaatgttcttggtattttccactatcatataataaacactatatagaaaattgaagtaataaactgggcatggtaggaagaatggatgaaaaacttgtacatggtgaaggaacagtatccctaatatataaaaagtgcctataaattaataagaaaaatgcaaatagaaaaatttgcaaagggtaaggacaggtaatttacaaaataaatttgagtgtcctgcaaacataaaaacagttgaacttcacaacaaataaaaatgcaaataaaaatataatttgttaccgagaggactggcaatgattaaaaatgaaaaataactgactaatttgaggttgtacagtagtaaaatctcatgcaccatgatggtgggggcaatataagtttgttcatcttttctgcagggacaatgtgagaaagtttatctaaattttaaatgtacacaccatttaaactggtgcttctacctctaaccatctatcctaggataataattggacaaatgaacaaaggtgtacaaatgaacaaaggtgtaggtatagtagccccttatttgtgggggatacattccaaatcccccactaggtgcctctcactgtgcatactactgaaccctatacaaatgtaccgtgttttttcctataccatatatacacacctatgataaagtttaatttacaaattaagcagagtaagagattaacaacaacagtaataaaatagaaccattataacaatatacagtaataaaagttatttaaatgtagtctctctgtctctcaaaatatcttattatactgtactcacccttcttgtgaagatctgagatggtaaaatgcctacataatgagacaaagtgagttttcgaatgacataggtattgtgatgtggcattaagctactatcaaccttgatattttccactatgacaatacatcagaaggaggataacttgcttttgagtggtcctggatcattgagccatgatgatttttcaaactgaccgtgggtaactgagacgatgaaaagcaaaactgtggataagaaggggactactgtgcaaggctattcatcacagcattgtggataggaaaaaagacggaacaacttaaatatccattttagctgtccgtatatgactagtaaataaattctggtaaaatggttaaaaagaatgatggagatatatgcttaatggcacagaagagcatcttgatatgtgagtgaaaaaacgagacaggtggtataatagcatgatctatatgcaaagtaatatatactcctatggctgttgtcctggagtgatgggacattgaagaatctttgcgtctttctggaggtgtacatttttctacaacaagcatataccatcttagtcaactttaaaaaaaattgcagtgccacaaccctgtcttgtttgatgttgctgatttgcctataatgaaatctataatgaggaagtacatgaattaaatagaatctatggatatatccagtctgtccagtgtgggaccaccagatcaatgcccaaggtttccatgtacccagatggaggaggagatcattttcagatccttgggtgggtgagacagccatcctcgtttttaagatagaaactttcattcatctcagtgaagagagtgtattcaggtctttgaacccaccgggctcaaaggtaatgatctataaccagataatccacagtaaggcctcttcaccatctgggtgagtcaatcctggctggaaggtcaatccttaggcagaccgtgatgttgtcttggacatcattgtttagagtgagaccaaaagggaggtgagacctttagagaccaaaagggagtttacctgtgatgcagggagggttggaatgaggaacctcagggcttgaaggctctgggttgcaggggtaggagatgactgatgggctggacttgttaaccccttgatgtcctacttaatctcttccctagctagtgcaatgatattgattagaatgatgacattcttttttttttttccccccttcttgtaagagacagagtctcgcttttctgcccaggctgaagtgcattgttgtgatcatagttcactgcagccttgaactcctgggctcaagcaatcctcctgccttagcctctcaaagtgctgggattacaggagtacaccatgatgcctggctgaaattctttagatatggtaaccacaggccccttatatttctacaacggccccattttcaaacattatatcctattatgaggcacatgtcctgatttttgctttggaaaatatggtacctgcacctttaaatgtttaatctcccccagccatgatgagaagaagagaggggaaggaagttggtatttaggggtgaatgcgattgagtggttatgtgaaggggcgggagggcggagtgaatgctgggggaccccgagatattttctttcttgtctgttttttccaccccatttctttttcctccatgtcaacaccaaacaagacaggactaaaattaatggggaaagcagcaattagcaaattaggttagcggcgtgttgccgagaggcccggctgccaggtgcggggtctctggcaggatatttattagggcctgtcagagaagtgacactttgataaatggagttgagtaatcagccccttacgacagcaagcattgtgaggcctcagcatgcacgactgccggagccaacctttgttatgatttttaaaaatttaacactcataaaagtaatacaacagcagcatccacggccacagagcatggcctcgaaccccaatcctgatgtgcaagggaaactgtggatcttgagttttccttttggaatgggcaactgggaaaagaaaccaatgtggaaaagtctgtctgagttttggaaatgccctagaattaaataataaaaaataaaaaacaggagtgggttttaaagaacaagaagtgggggagttctgttttcacttggctagtctgcaaaggtgaccgtttgctgaggcgccagagtggctggagttgaacagggggaacggacactgggaacccaaggagggtggctccgtacactgatggagaggcccctgggaccaatgcctgtaaggatggcttgcccaagattcttgctgcagggattcctttccttggcaaacacatgcaatttagctttcctctgcaatgaccagtttcctggagggaggattcaataaccaggcagagagcagagcacactgccctagtgacagggtttgaaggaggaggaccaggttcctggccagagatgggtcactgtgactttcagaagctctccatacctggcaaatctcactggagtataggctcaatgtgaacaggctggctggagagccactgcctctgtttcctggccttcagcctgctgcttcaatgcctggcgtcgcctcacttccaccaggtcatagtcttcctcagctccccactgagagcacagtttcccttgcctgagtggtatagcagtactagaaacttctcatttgactgatctgctagctcttatggtgtctcagttgctggaatcctgctctgatcctgttttgcttggctggaccctgactcttcgccctctcctaacactccctattgcactggactctgtcactctgtccccaggtctggtatcctgatcagggttggatgcatctggatattgatgtaggccgagtggaactgaatttgctatacctctgtggacattggcactggactgctgacttctcaccttggggccaggtccacagccaggtggccagccccagcctgctcctcttccccatctagctcctgctgaggttcaaggagctgcaggcctgacccatgccagtgatggttctgggtgagtgcctttgataacctccagcaggtgtgtccccaaaggctgactcagtctcacgttccctaacacatggccctgagtagaatgacagtatctgtggtaggagggagatgggagtttgggttgtgactggttgttccaggtatcagccactagtgtctcctgcctggccccctataggccctgagtctctgaaccttccttcgggctgggaccagaggctgataatagagtgagcctcttcccagtcttctttggggcaggctcaccgcagtccatctctgtggatggacactggggcatggtgaggggtattggactctcatgtcaaggagggtggggaaacctggggttcacatcctcacctcaggagtccgaatttgggatgaagggcaatgtgagctatgctccctagcaccttgctaatgttctgccggacatggcttttgccattggtttgagttgggtcaagccagggaagatccttgagctgggcacagagctccaggtgtgctctgtgcagcacagaggactatagaagggtcccctctcatgacccatgtgcctttttcaggaaaaacaatcctattattttacaagagggtccacaggatttcaaattcttttcccccgagcttatgcaatatatgatttgaaccgaacttcaatgtgtgatgaaagaatcacccctgttgaatttcctttgttggttttgtcccagccatccagtttgtggagatcattttgattctgccaaatcagttatttcttaggctttggaagagaagagctcattttctaagtctgtgaagttataagagaacatggcaagaaccaaacctgtggccccctgctgagatgtctgccattctttttttccttttttttttttttttccagacagggtctcactgtgttgcccaggctggagtgcagaggcatgatcatggctcactgaagcctcaacctccagggctcaaactgtcttcccacctcagcttctcaagtagcttagcccttaggtgcatgccatcacacccagctattttttttttttaaagaaataaagtcttgctatgttgcccaggttggtcttgaagtcctgacctcaagtgatccttctgcctcagcttcccaaagtgttgggattacaggtgtgagccaccatgcctagccatgtcttctcttctcttttttttgagacagggtctggctctgttgcccaggctggagtgcagtggcatgatgtgggctcatggcaacctctgcctcctgggctcaagtgatcctctcacctcagccttctgagtagctgtaactacaggttcatggcatcttgcccagctaattttttttttttttgtagagatgggcttttgctgtgttgcccaggctgatctcgaacttctgactcaagtggtctttccgtcttggtcttccaaaatgctgtgatttcaggcgaagcacctgctccttcctctacctgggaagccccagccccaagaatctgcatggtctgcttcccaaccttcttcagtctcagtcaagatgcccccttctcagctcttccctgaccatcctacttaatgctaatttccccactgctcattctgtccccttaccttgccttggtttttcttcatagcaatcattgccatggaacatactatacatgttactaagctgtgtgctgtgtctggcacctcatgcagctacctgaggacatgggttctgctgattttattcatgctatatccacagtgcaagcacagagcctgaaattggtgctatctcaataaataaatatttgttaaatgaatacttgtctaaaatacagatattatcagtcccaagcatgggcactgcatcaaaaaggaaattagagtaatttcacctgacattctctggagatggacatcagatcatggtaattgcttcattctttttaaattacttgccaactgaccagtttatgagaaggtctagagtcaaaaaagggattgaatctgactgcttcctgttttggaaaatcaatacattatttttcttctggcttctccagcattctccttggtttcctaaagattcttcatgtgactttgagatggtatcagtgagattctgctgttccctcccaccttgtctgcaatattgtttcaaagcagagtttttgcaccatcatcaacctttcctgtgtgcctgccaggtgcagagcactgtcctaggccttgaggacacaaagccacagagaacactttctttgcttcagagctttctcaggagtcatggtggggggaaagctgtatccaaagtgacagtggcccagtgaagccacatgttgagaccatgtgattaggtggacagtgaacatgatgggtcgaggctaggtcagcatgggcatggggatcttgcagaccctgctgtgaggttttctttctgtggattatgcactcaacaaatatgtattgagcttctgccatgtgtcaggcactgtgctgaacactggggacacagtaatgatttggacagatgcacatcctatcctcatggagccacatagtctagtaggggtgataaacaagtaaacaaataaaagaatattttgcttgttacaggtactgggaaggaaataaacatagtgatgagattcaaggtgaggtgaataattatttagatagggggtcagagaagtcctctccaaggacttccaaggagctagccagggagaacaaagaaaggtcattccaagtacctacagaagccccaaggtggcaagggcttgatgtgttatggaatctgagaggagaccagtgtgctggaatagactgtttgggaaagggatagaatggtgtgaggtaagctggatggggaaggcagggatcggaccatacaccgcaccttgtaggtgatgagagggcaacaggatttctgttaggagcaatggaaagtattttgggggaatagcatggtttcacttccattttacagagattgctatggctacaacatggagaatagattgaagggaagtaagaggaaaagcaggacgactgatgaggaggctgctgcagttgttctggaagagatggtggtggccagggcttggtgagggtggatgagatggagagaggtggctggatctcaggcgtgctcaggagttcaggtcgacaggagttgttaatgaattgggtgggattagggagaaagcaggaatgactcctagttttcagtttgagcatgcggatggattgtggtgccatttacaggaagaacatgcttatccagattcacctggtagtgagtgatgagttatcaaccttctaaatcaccacaggtatgaccactttccccccatcaccagagtcctaacaagaaggctgtatgccccgtgctgggtgagctcctgtcattcccaggctttgcacaggtggtgggctttcagaaagcaaacatccctgctttccagaagcttagtgtaagattttctatatataagactgtgtcatctgcaaacaggtataattttacttcttcctttcagaaaaagcttttgactaaattcaagtttggatgcctttatttttcttgcctcattgctctggctaggacttctgatgctatgttgaatagaagtggtgagagtgggtatccttgtctttttcctgatcttagaggaagagtttttagtttttcaacattgtgcaatgttagctgtgggtttgtcttatagggcctttattatgttggcgcaaattccttttatacctactttgttgaaaattttaagggtatgaattttgaatttagtcaaaagctttttctgcctttattgaggtgatcatgtcatattagttctttattaatgtggtatatcacattaattgattttcttatattgaaccatccctgggataaatcccatttggttatggtgtatgaacttaatgtattgttgcatttggtttccttgtgttttgttgagaatttttgcatctacattcatcagggatattggcctataattttctttttggtagtgttctcatctggttttggtatcagggtaatgatggccttgtaaaatgagtttggaagtgttccttcctcttcagtttttttgaagagtttgagaaggattcgtgttagttctcctttaaatatttggttgaattaaccagtgaagccatctggtcctgggttttctctattgggagattttttgattactgattcaatgtcctcatttgttattggtctcttaggttttctattttttaatgattcaggcttggtaggttatatgtttctagaaatttatgaattctaggttattccatttattagcatgtaattgttcatagtagtcttttacagtcctttttatgtctgtggcatcagttttaatggctcctcttttacttctgattttgagtcttttctcttttttcttagtgtagataaaggtttttcaatttttatcttttcaagaactgaactcttagttttgttgactttattgttttttgattctctatttaaaaaaattttgctctaacaataaaggccatatacaactgatgtggtttgtctgtgtccccacccaaatctcatcttgaattgtagttaacataattcctacatattgtgggagggacccagtgggaggtaattgaatcactggggtggttacccccatgctgctattctcatgatagtgagtgagttcttatgacatctgatgattttataaggggcttcttcctctttgctgggcacgtctctttcttgccatcatgtgaagaaggatgtgtttgtttccctttctgccatgattgtaagtttcctgaggcctccccagccatgtggagctgtgagtcagttaaatctctctcctttatgcattacccagtctcagcagttctttgtagcagcatgagaacagactaatacaacaacaaacccacagttaacatcacataatgctgaaaaactgaaagctttttctctaagattagaacaagacaaagatacccacctttactacttctgttcaagacagtgctggaaatcttagctagagcaattaggcaagaaataaaaaataaaaggcattcaaatcacaaagggagaaataaaattatctctgtttatagatgacatgatcttatatgtagaaaaccctaaaaattccacaaaaaacctgttagaagtaataaacaaattcaataaagttttagggtgaaaaatcaacataaaaaatcaattacatttctgtactctcacaaggaactatctgaaaaggaaattaagaaaataatcccatttacaatagtatcagcaagaaaaaaatactaagtaatagacttaaccaaggaggtaaaagacttgtacactgataactataaaacatcagtgaaagaaataaaacaagacacaaataaatgaaaagacatcccatattcatacattgaaagacttattaaaaatgttcatactgcccaaggtggtctgtggattcaatgctatcctcatcaaaatcccaagggcattccttttttttttttcttgtttttttgttttttttgtttttctttttaaacagcagtagaaaaaacaactctgcctctttggtgcaggtttctgcaatgtacagttgatgagtccttcctctgtagaaaggcagtgtggtgtagcaggcagaacacaatgattttggagtcagcaagatcatcacttttatgccttggccacactcaacagtagtgttgggcgaggtttatcacctctctgaccctcagtctcatttgggttaatgccaaatgagtcaataaattatataggatagtttccaacatataacaggctctcaataaatataggttgtaaattactacagaaactcggaagctacatctcaaagccatacacattagggagggctttatctttaccccagcaaatcttgggcatgcacgtcttccagaccagggatctacacatgggtgagcaaggcagctttaaccactctgcagctaaagggaccttttggagcactgttttggggttgcatgtggcagggaggacattaacattggacatggttcagtgagaacttgggctggtcaaatattatgatcattattatggtacaagggctacatggaatggccagatgattttgtccttggaaaccatgggacttgggcagagaggatgcttctttcaggctccagccatgacagttgtcccaaatcataacagaaggaaggatttaggccccatgaattggattaaacttttacaatatcctataacctttgctatcgtcgccacgactgatgtcaccataacaacaacgataaccaccccctccccaatataagtttcataatgatttgttcattgcaaaatcaccaatgcctacaggagttcctggcatagttgtaaatattactgtttataataaccattaccactgttaaagttagtagcagctaacatttaaaaaatgcatgtgttcatcatctcatttaattttcacaacaatcttatgatttaggctggggttcacaatctacaacctgtagaccaaatccagcctgtggcttattttgtaaggtctgcaagctaacaatgctttttctcattttaaaacagttgtaaacaaaatgaagaagattatgaaacagagcatctggcccacaaagcctagaatatgtattatctggctgtttgccaatccctgatatggagtatttgccagagtaggctagtgatatagtttgaatatgtgtccccaccaaatctaatgttgaatggtaatccccaacattggagatggggcctggtgagagatgtttggatcatgggtatggatccctcatgaatagtttgggtcatccctttcgtgataaatgagctcttgctctgagctcatacgagatctggtcgtttaaaagtgtgtgatacctacacccttgcacctctttctcttgctttggcttttgccatgtgatgtggctgctgctcctttgctttctgccatgattataagcttcctcatgtctccccagaagctaacaccatggttcctgtaaagcctgtagaactgtgagccaattaaacctcttttctttataaattgtccagtctcaggtatttctttatagcaatgccaaaacagccaaacacatgtagtgtatgctgccataacaaacaatgaactgaatggcttagcctaacaaaggtttatctcttgctgactcaatgtcagctgtgggtctgtgcagccctccagcgcagtcaccttccagatgatcagccatccaggctatttttattctgcagctctgatatcttagcatgagacctcttggttattgtggcaggggaagagagaggttggagagccttctgggaactttttagtgtgtcattcagatgtgacagctgttacttgcacacgtgtttcattaaccagaacttgtcacatggcccagcctaactaactatgaggggttaagaaatgtgaaggagcacctggaatgagatgaggaagctgagtttctgagaggtaaatcctttgctcaagcttacacaacaaggaaaaggcagaacaaagacacgtatcaggcaagtacaatttccaaagtccgtgatcttatctattacattctccttttcttatgagctccttgttccagcaacaaaccgcattaaacatttcgttactttggagtggctcagacagaatgttcctatggttgctgacacatctcccagagaagtcttcccagctctacacccccactcccagcctctgtcctcctggctctggccccaaaggggctggaaggtgccacagccagagtaactcatgactcctttggctcctcacagtgatgaatgacagccatccatcgtgggccttgctgatggcccagctcatccatcatggcctggtgttctcaggtgatgtatgagtgcctgaagaatggattgcttaacggccgatttgcttggaaaagaaactgagccaaagagtggattcaatctaattacctgctcactctggccaggcctgagaggcactttggcagcccctcataggtccccgcagaaatatgacttgcagttcttgagctacgaggtcattcctaactcattgctgatggacagggcattatttaaaaaaaaagaaatgtggggaggagctgttggcaggtttgctgcttgatggaaagctaggcaggccaggtgaatcttctggaggtgaatcaagggcaaaccaaacaatatttggggtgataattgagatgaatcagaggtgttgggtcaatggacaagtcagtagtcaagactgtgagctctaaagctcaaaaggctacaagactgtagccttggttttgtgtcctattcctgtcacttactctctgtataaccttgagtaagtctctgaacctcagcttcattttctataaaataaaaataattgttgtgagaatttaatggaataatagatatgaagtgctgagcatagcaagtcagggcctagtaagtgatggtgagaattattataatgaaaaataatattaaagattgttcttcttgatatctatcacttaggggttgcagtattgccagagagacagtattggacaacgataactgcaaattgttattctcccactgagagatggagtggctggcctcatgtttacttcaaccaatggaatatgttggccactggcctctgctcttctctctccctgttcttattccaagctgcccttgccatatctgcttctgatccccttggtttggtgacatgctaggattctgttttctggccttcagtatctttctattagtgtctcagctctatatcctcctttaactatggtgcccctgaagccttggtgagagtcactgtctccactagcctgagccctgcaaagcttccattggtgctgtgccagttctgcgccttgctggcctttaagagaactggattcttctacttgcttttttttttttttttttgaacttgctctggggaaagccaaataatatataagatgttcaattaccctgagactgccatgctatgaggaagaacaagctaaccacctggagagaccatgtagagagggatgcttggccagttctcatcttttctagccattgcaactgaggtgccaaacgtgagtgaagaggtcgtcttggatgtccagctgagttgacctttcagatgaccatagtcccagccaccatgtaactgcaactgcatgagaaaccccaagtgagaactgcccagctgagcccagtcaatccatagaaaaatgagagggagtgataaattgctatgctgaactactaagttttgaggtgtttggttatacagaaatgaataactggaacaggaaccaatccggataacgagtttattcaaactaataattattgaatattaaatgccaggaattatgctgggaaaataagctggtggatattggtcttgcagcctaaaagctctttcaaaccttagagttccaagatatggctgcagagaatgcctttcataaattgatgtgctttttcagcctcagggaggaatataccacttattttggattatgaaacttaaaaatgccttcttttgtaccgactttcattcccatacttaattaacccattcttattttatttttacattgaatatatcacagaacactaattttgtaaaacagtatttctcaaaccatctgtgttaagatcagtgcacatgtgtgtatgttttaaattttcaacctgttgcatgcagactgatacttttgtaaaatacaacaaaaatgagttactgaaaaaatgaaaaaaatacacaaaatacaggcctactttttattattagattcaacagacatatagttactctgtcaaattgttattatggttcctaaacagctgctctcaatttcgtttcttgttacacgtcaggagccagtttgtgaacagcaagtatctgtggatcacacaccaggaatagtgctgctgtagaacacacttcacatacctcaggaaatgctactgtagattaaagaaaatgcagaattggggaagggcttttttttttttttttttttttttttgagtatgatgggacttgagtctgttttgtattttgagaggaaggagccaatgttgtgggagaggctgaagatcctggaagatgggcggactgatggaataatgcctcggagactgcagtagataaacagagagcaaggcctctcccaggaggtcaccaaaactgcccacctacctcctccctaacccactggcttctgctttcctctctccctgttcttattccaagctgcccttaccatatctgcttctgatgcccttggtttggtgacatgctaggattctgttttctggctttcagtctctattagcttcttagctgtatatcctcctttgactatgatgcccattaagccttcgtgacagtcgctgtctccatcagcctgagatctgcaaagcttccattagctgcacaggcaccaaaggaaggaacctgtgggcacgttcagtgggtgaacctggaattagcctcatggccacataagccctgtatggacataccttttctttctgtctgtccagctttgattattttaggaactaccaagtcctttgtctataaacatcttggtcaggaaactgaactttccaaatacggcttttaggaagcttatacccctgccacccatgggtgggcatataaccccgccaggccaatcagagcctttgctgggacttttgcttgacgtattatgaaaaatgacattgactcatttggaatatagccttaaggacagacaggctggcttggtcacccctaagagggggtaacctacctaaggacacaatcaagaagagcaaagtcaagagactgagagggcttgattaagttctgacagcagcatcacttggattctgctgtatctcagacttagacttcccagttatatgagccagtatgtttcttttttaattttttgcttaagctattttgaattgggtttctgtcactcacaaccacaagagcttggatgaatacattcatagttcaggggtggtaaacccatgatacatgtcccactagttcctaccttctgtgcccaagataggcatgttaataaatcacaacactcttactaaccctagacttgacttcagaatttttctcaacatagaactacaggcagcctctcccaaccaactagagcatgcacgtgagatgaaagttacttgttatcctcaggggaatattggatgatgcaggtttctgtcatgttttcctgattctgtggctggtgacctgccatctgcttcaccttatctgttcttttcagtaattctttccccaagaatgagaacccgggactttcatttccacctgcttcttgaatcctgctccaaatatactcaagtcttgcagttatgactttgctgcctatgtgatggaccgaaagtcacctctccttatatgctcccatcctgggcttcattccccagtggttacagatgcagccttgctgtgctcctctacactgagaaagtccccctgccagtgagttaatcccatcctgggattaactcatgtcagtgaattaatcccatcctgggattaactcatgtcagtgaatttttaacaatggcccacttgcatcacacagcttggattgtcctataaggtgtcccattggtgactgatgtagtcttctttcaatctattctctgcatttcagcaggagtggtctttcaaaatgcaaatgcaaaccatattattctctgtctataactctgcaaaggcctcctattgcatttatgttctacaaatgttgacttcttgctatggctttcaatgccctgcacagtctgctgcctgtcagcccacccagtctcatgctgaatgaccacctcctcaccgtttgcactgaaaccatgtgagcatctgtcagttaatgtctcctgctacagggactttgcacatgacatgccctctcttcttcatctccttgattcctactcatcctcaggtatcagctgagctgtaactttcatggggaagcctttattaatcactctgattaacttaattccctccatatagaataatctagctataataaaagagctaacaatatatagcacttactgtgtatcaaggcccattataagaactttacacatgttatttcatttaatcctcacatcgatcctatgaggtcggtactattattatcccattgtacagatgaagaacctgaggcatatatacctctcctccataccacttcttagagttggaattttatgtttatttgtacttaaaaaaaaatttgtccctctctgcccttgaatgtgagaactgtataaacagggattctatctgcttttgttcattacaacatccttagtgcctagtacaggacctgacagaattggagctcaataaatatcttcacctttggcagccctgagccccaggggccttctctctctgtctttgatggtcatccttccaccctctagtctgcatgtttgtgtagagttttaggatagggctggagtgtctaagagagtgaggctccacaacttctaggcagcctttcagctggtaggagcctttcaggctgtgcaagagtgatggggagtgatgtgggttggctgtgtccccacctaaatctcatgttgaatggtagctcccataatctccatgtgtggtgggaggggcgtggtgggaggtaattgaatcatgggagcattttccccatgctattctcatgatagtaagttttcacaagatctgatggttctataaggggcttcccctttcatttggttctcattcttctctctcctgctgccctgtgaagaggtgccttccaccatgattgtaagttttctgagggctccccagccctgcagaactgtgagtgaattaaatctctttcctttataaattacccagtcgcgggtagtttcttacagcagcgtgagaacggactaacacagggagcaaagaaaggggtatttagggttaaagacaaggctaactggatggggcagggtagggagagacattgagcacagctgcgggttgaggccagggccacagaggccaagccccagtgactgatttcttggatggttggagctgagctttaatagcagccttgacaatgacagtgatggaactcactaccacggagcctgcgcctgggtcaggcaatagatgggggatgagaagcaagttgtacatggtgcatgcatacattctgtgtgtgtgtgtatgtgtatgtcgtgagtatgagctgtgtgtgtacgtgtggttgtatgtacattcatgaaatagctgtgattttatataattgtatgtacattagtttgagccaaatgaaattgccaataaaagagcaatttcatatggttgagcaaaatgtatacacatatggatgaccataaatcatgtgaacatgtgaagcatttatggatattgcatgagttgatgctgcctgtggcacagtctcagtatgtgtgtttatgacatcattgcaagtgggcatgagctgtctaaggtggcagctcatgtatatgcacatggtgcatgtatgtacacatggtgcatgtgtgtggtggtgaggagaggctgatgaatgtgtcaagactgtctgccatatttggatagtgacacataccctctaataacagagtgagtagacatgtgtcttccaataattgagtaaggggacacgtgctctctggtaactgagtggccttcattttagcccagggataaggtgtatctcgcagaatacaatggacacccccaatgccccatcttgtgaacataggagacaagctgctccttggcttctccaggcactgtctttgatcagaccttatacaatacacattgccccatctcacataacctttatgcctaccattgcagggagagtacatcactctgttagaaaaatccccaagcagtcaatattacttgcttctggaaaatgaggaagaaacagtgtggcagaagttaagtaaccttggaatagcataaataggcatagacatgataaatagggcataatttgcagaatcaaatcctggatctagcccttactagctgtgtgactttggtaaacaatacttaaattgatttcccactgttaagttttacctagcacaacgccttagacatcatagtgctctttgccacagaatctggggtttgaagtaagtgtttcctcttatgcaaaaaatagttataaacatctactatgggagttatttttgctattcaccaatatttctgggttttggtctcttagacacgtgataggattgaatttccctttctcttttagtccaggtgtgccacgtggcttgttttggccaatgagatgagaacacagtgacatggtggaccgtttttaggtggaagttttaagaggtagtgcattaggtgccatgttttctttcccctgctttggctaagggaaatcctgcaggtgaagtcttcctcagcctgggtctttgagggaggataagatgcagcagggccccagcagacctatgacagatgtgctgtgtagtaagacatgaagctgttgtttcaatcccgaaattttggggttgcttttgcagcatgacctgtcttattttgctggacaccagttttgccttttggtccacctgtatggtaaatactcatcctcatttcacaaatggcaaaactggcctgagacatgttaggtttatcttcagtcagtcaacaggatcaaccttttggtttgaaaaaaggtgacatttgggacctttgctccatgagtactttgagtgtgccagaatggtgacccaatctcagagacatttctttagggcattggggtgttggccaagggagggcaaatagactctcataagtggagaagaatttgtacaatattttatgacctgattctgataacaaaggaagccccaaagtaggttagggtgataatggagatttaacttgctcctgctgggaaattcacccagcaagatgcaaaacccagaatagatcacttttcatttctcagagttacacaggttatagatgatcattgtataaaatttagataattcagataaatgaaagattaaaaaattaaaatcatctaggcttggcatggtggctcacgcctgtaatcccagcactttgggagaccaaggtgagcaaattgcttgagctgaggagtttgagaccagcccgggcaacatgacaaaacccagtctctacaaaaaaaaggaaaaatcatctgggtgtggtggtgcatgcctgtagtcccagctgctcagagcctgaggcaggaggatcaccagaacctggggacgttgaggctgcagtgagccgtgatcatggggccactgcactctaacctgggtaacagagtaagacctgtctcaaaaaaaattaaaattatctgatattctgctacttagagataaccaccattcatattcaaccttctaaacattctccatgtatactttaaaattggtgattacagtaattgctttatcttttatctcatttaacacatcataaatatccttctattttaagtaaatagggggccatatcatcattttaaatagctgcatagtattccatcatatgaagcatcaatttattagtatttcttaatgagtccaatacttttggacctttaggctgtttgcaagctcttgctgttataaacaatattgtgataaaactccttggaagaaacatcttctggcacttgcctaattatttccttagaataattctttgaagtaggattgctcgtcaaaagaaatgtactttccaagggcttttgttgcatattgccaaattgctgtccagaaacactgcattaattttcagtcctagcagtaatgcataggaatgtccttttcttgatttccacatcagtccagcgtattgtcaatctcttaaacctttgctaattctaacagtgaaaaattgcacttcgttgtttcaatttacatttctttgattcctagtgagtttagactatttttttaaaggtgcattgttagaataccttcttggtgatcctattggaatcccaagaatacagaggagacaatttgttctttcattcattcattcatttaacatgtttatttgcacctactatgtgctaggcacagttttagaagctgaagttacaacagggaataaggcagacccagtccctgtttcagagcctatatatagcagtgtgtgtgtttggggggactaggatcttaaccccagggacatcaggctcctgaagtactagcggagtaattatagaaagtagctactcagttctagtcagcatgggctcagctgtactacagccttaggcaaaaagaaaaaaatccataatgtgaatcctatctttattcaaattttgatattttgttcattatggatttttgcactaattatgattttaaaatgttgccatataatatgtattctgattgctgagttttcttggtgcacttttaagttctgtacctgagaaaagtgcctcactcatcttgctctaatctcggccctcctaatctatttctgatttctaaaatttctgtgcacacacaggtgagaccctgcaacctgaactcagggctttccagactcataaataagtgctgttctgactacacatccagaaagatttcaagtcagtccaataactattactttgaggaattgctgtgttccagggcctgtgtcaggccctgggatataaagacaagcactcagtcaccattttgaaggtgagatttagaggcctaagtaaacaatataccctgtaatcgtccatcagccatctctgtccttagaagtacatgtgagtagttatgccatcttgttcccatcctggtctcaatctttggtggaatgattaccacgttctcaaaggtcttggaaaactaaatgttaataatgttaacctaaacataaaataactgaaagctatttaagtttcccctgtgtgccaagcatgacactaggcacttgtagcagttaagtaaaagggagaatttaattatggagttgattacacaggtgatggaaaagttgagaagcttagtaggagagggtgaggccatccagactttattcaaaagtgggaagccactaccatctccagggctagagaggcaaagggaaatgatgtagttatcagggctttggggcagaagttgaaatatcaagtgtcctgttccacaggagctgaaaacatcgaggaggttctgctcttgctagagatgttgcctggggagggaggaagaagatgatggaaaaatagccagaattttccttcctcttgccttccagtctcccaacaggacttcccattggccctctcctgctggaagccagctgatcttgaagccaagtcagaggttggctctctttgatagagaggagagttagggaagagggaggaacagatctgattgcaaagaagtcacagaatagcatcctcctgaacataaaccatctttaaaaattctcattaccaccctgaagttaagtactcttgattccattataaaaacatgacaccagaaaccaagaggagctaagagatagctacagggacacacagtaataggggaattggatttgaggttaggcttgcttggggccaaggtcctatttttcccacaccacaggcttcctctctaccctgaatcatcccaccatcatccagggcatctccagtgctcctgagggtcacccctcccttgcccttgctttacagttgcttggctgccccatctccaatgactggcacttactctccatcagccaccatgttgcacaactcctttgaattttatgtgaatggtattcctggagttatccaatgggatggccctgttgacaactacctaagcccatgaccatggtttggatctagtcattatatttgaacacttggcctctgaaatcttaggttctaagaggtccttccctgctgtccttcttcctcctttctttcacttttgttgacttgcctttttgacctttctctaaccccattggtatttatttccctactctgagtctaccagcccttcctggattgaatccccaatatgcccaatctaggcttcattgttgtataccactcctgtgacctttgtctgatacactcttggcagtcctacgtaacctttatcattctttgctggagaaaaccacacaactgtggagattgagctcattacacacttatgatttccacgcctgcttagtgcccttggatggtcccctttgctcagctgtagtttaagaacttattttcccctgtagtacttacttctaacctcatgatctccccgtgggccccaggttgcctttttccgataaaggtcccaatgcctacattcatctgagccagctgggctgccagtggaaatgcgggggtgagaggacagggcagagcacaaagattcagcgtgtcttcacagaggtggtaatggtggtgcaggtgtaacaccagaggtacaggcaggaagactaagaccagatgttggccattttcttctagtgcatgcaaaatgctttattttcttgaggtttccaatttcccaagattcctaggcttgatggcttcataagggttaactcactatcctatggctctgccattaattactccagtggctgcagacactgcacggagctggatcctggttgttccagcttcagagtgggtttattgccaaccatgcattatgaagaactaattgtgagccccttgcacctgctggttccccctgtggctgggactcaggaagtggggggagagttattaatgagcttgttgctcattataataaaacaatggggaagttggcaaaggagctggtggtccaggtgtggtgtcagagaaggctggttggcatttctggaaacatgactttacagtcatatcatctgcctccttccctggctcatgctgtgacaccaagtgataaaagagctgtcatcctgagggccactcagagtccttgtgaactcatgatcagcggaagccacctggatggaggaattgctgagccagcactctgtcctggctgagatgggctggggcatggggaatgctgggatttcagccccagagcagaggggacagacctggctgtgccctgggttatctaggcttaatagatacagctgagaggagtggaagccagtggaaggccaccagaatgacaacctcttgcacgttgaagagctctggataggtaatggtttggggcacagatacagggctgggactagggtaaggcaagccagggtgcagaatttaaggaggccttcactctcaggcttgtgcaaattcagaagcagcattaagagtgagtgcctccttaatgtttgtgccctgagtgcaccctagtctgggccctgcacaggtgggtggctatactagaagggccaggtggtagctcctccttgacatcctcccttggagcttgaggcagatcagtggacatctcttcctggtcgttggttctccagggactggtctggaagcccactcaggaaagtactatgatgacaactaacatcaactgggcagtgccattattaattctccttctcatttaattgtcaagacatacatggaaggggggtaagaagaatattcttccatggtggtgaatagggcaggctcttggattacagtttctgccttcaagccccaactttgccacttaccagcccagtgatcttaggcaagatgctaataccctgacatcttggtttcttggagtgcaagtggcttcttctgttccttgaatatatcaatttgttttcacctggaaagttcttctcctagatatttgcatgatacttttttcatactattcaagtctcaggtcaaatgccacttccttggagaggccttcccaggcaacctcatctaaaggagttccttaccaccatgtctaaatattgttacattaaattattgacttcatagccattatcactctctgcggttatctttatttccctgatatctgtcttcaccatttgaaagtaatttccatgagggcggagattttcctatttattgctgtatctatagtgctggaactgtacccagaataggtagttgctgatataaaatgtaaataaatgaattatttagaaatggcacttaactcactgtgttcttgggaggactaaggaggcaatccatgaagagtttggcacatactaagtcctcgcctctgagattcaaggagtgtaagtgacttgtctacattcaccagccagcaagtggcagccctatgacccaagacccaaaatttgtgctgtaaccttctatccatcacaggttcccaggtgctttctgatgagtcagaaaaagaagctgggctgaaaactacagcttctctggaaaagagggaatcctggggagaggagagaagaaatctgtgtgggtagaactatcctacagctctatcgtgagaatgatcaggttgtcataaacaggaaagatattaaacacattttacagctggactgtgacaggctaataatggcttcaggagatagtctatgtcctaatccctagaacctgtgagtgttacctttttagataaagggtctttgcagttttgattaagttaaggatgttgagatgaggaggtaatcctggattatctgggtgggacctaagtccaaacccaaatgtccttttaagagagaggcagagggagatttgatataggcagaagagaaggggtcacataaaaatggagacagagattagagtgatgtggccacaaagtcaggtggtgatatgtgctattttgttagcatgatcaggcaaggattccccaaggaggcaacacttgatcatacacttgaggaagcgagagaatataccatgtgaatatctgtgggaaaagactttccaagcaaaggaaacctcatgctcaaaggccttgaagcaggagtgtgcctggtgggttttagggaaggtggctggagtgtagcagtcaaagaaaaaagggatagaaagtacagccagaggtatggcctgaggccagggcatgtctggccttgcaggcaacagcaaagactgattttattctaagtgtgataagaagccattggggagatttgaaagcagagagtggaatgctctattttatgttttacgaagattattctatttgctgtgtaaagaatagaacagaaaggggcaagagaagatgcaggaaacccaattaggaaactatttcggtctgttcctgttgctgtaacaaaataccacagactgggtaatttataaacaacagagatttatttctcacagttctggcggctaggaagtccaagatcaaggcaccagcagatttagtgtctggtgaagactcactttctgcttcatagatgatgtttcttactgcattcccacatggcgaaaggggaaaaagggccaggcagttctctgaagccccttttacaagggcattaatcccattcatgagggtggagccctcatcacttcccaaaaaggtctacctctaatacccatcaccttggggtgtgagtttcagcatatgaattttggagggacacatacattcaaaccacagcagaggccattgcaggcagaggttgatgatggcagcttggtctaggtgttgggaagaaggcggtaaaatggggtcagtgacgtgatacattttgaaggaagaggcttgtggtttgctgatgtattggatgtggggaatgaggaacagaggaatccaggatgattccaaggcatttgcctgagtaactgaatgaacgatgttgcttctactgagaggagaaatactggcaggagggcagatttaagggagagaatcagttttggttgtagaaggggagaatggtaaagaaagagcaattagcagggaagcatatattgaacactatgttaaaattcatagtgctgcacttcactccgcctttctcttgggtagtggaggccatttgaacttccagggcttgattggcaactccccaaaccaggtgagtagtggtggaaataaatccagaaataaacccaaaatgtattaaagacttaaatataagacctgaagctgtaaaactagaagaaaacagaaaacttccttggcaatgatttttttggatatgacaccaaaagcacaggcaacaaaagcaaaaataaatggactaaattaaatggaaaaatttctgcacagcaaagggaaaaattcaacaaaataaaaaggcaacctatggaatgggagaaaatttgcaaactaaatatctgataagggattaccatccgaaatatataaggacgtcctgcaatgcaatagcaaaataccaaataacctgattaaaatatgagcaaaagatctaatagacacttctgcagaaaagacatacaaatggccaacagttatataaaagatgatcaacatcacaaatcattgggaaaatgcaagttgaacacacgagatatcactttacacctgctaggatggccattattaaaaaatgttaatgaagatgtgaagaaaagggaatgctggtacactgtaaatgagaatgtaaattggtatagtcattatggaaaacagtacagaggttccttaaaaacttagaactaccatatgatccagcagtcccacttctggatatcaaaattaggaaggaacagaaattaggatcttgaagagatacttgcacttctatgttcattgcagcattgttcacgatagtgaagatataaaaacaacctaaaagttcactgttgaatgaattaataaagtatggtgtatacatacaatggaatgttatttagacttaagaagctatgttgtcatttgcgacagcataaatggacctagaggacatcatgctaagtgaaataagccagacacagaaagacaaatattgtatgacctcattgtatgtggaacatactatagtcaaactcacaaaagcagaaagtagggtggtggcttccaggggtgaggggagcggggaagaggaaatggggaggtaagtgatggtcaaagggtacatgtttcagttatgcaaaataaataaattctggagatcactatacagtatatagtgcctaaagctgacaaaactatattgtatacttacaaactttaaactttgctgagagggtagatcttctgttaagtgttcttacacacagacacacagacacacacacacacacacacacacacacatatgcacacactaatcaaggaggtggaaggaaactttaggaggtaatgcatatgtttatggccttgatggatatgtttatggtgatggtttcatgggtgtatatttattatatcatcaaactcctggagttgtatatgttaaaaatgtatagctttttgcgtgtcaatcatacctcaataaaacggtttaaaatgtaattactttcttaaaaaatgcctcgtacagtctggaccaggttaaaactttattctcacatccaattcattgcccatctcctttgctctcctggttgacagccaggcttttcctgggaaacagtgatggggaggccccgtgtctgcccttgcccctcttgccatctctccccatgtcttttctccctcttgaattgcttgactaggcagatgtctaatgagggaaggagatgtcagttaccctgcatcttcctgttatcccaagctctacaagtgatttctttgaagtttccatcccacacttgcttagagaggtgggaataactcctttctccctcaaggcgaagaaggaaaaagacatgattttctcccctcccactgtgattcacagtgtttcttctttcactttgtctcctctctcttggtcttctgcttatatggtcctggtagtggtgggttcagggagacctggatgagggtggcagaactgactggacagtgtgttagtccaggacctcctagaagctgacatagaaataggaatagatgtgcaggaggaaatgctttttgtgatggttacttttatgtgtcaacgtgactaggccatggggaacctggatatttggttaaacattatcctgggtatgtctgtgaaggtgtttgtggatgagattaacatttaaatcagtaagctgagtaaagcagattgcactctctgatgtgtatgggtcttattcaaccagtttaaggcctgaatggaacaaaaaggctaccccctccccgagtaagaataactcctgcctgactgccttcaaactgagaccttggtttttctttctgccttcagactgaagctgaaacatgggctcttctgggtctctggcttgctgactcaccctgtagatcttgggacttgtcagcctccataattgtgagccaatttcttataataaataaatataaaactatataatataattatatttatataaaatatttatatgaaatcattagcatgtctaaattttaaataatcctcagacaaaccacaaatacttcaaaatcgaaatgagaaaggggatataaccacagatacaaaagaaattaaaggacaataacaagacaagaaaatttttttttcattctttttttctaatgtattatactctaagttttagggtacatgtgcacaacatgcaggtttgttacatatatatacgtgtgccatattggtgtgctgcacccattaactcatcatttaacattaggtatatctcctaatgctatccctccaccctccccccaccccacaacaggccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtcccttcaaaggacatgaactcatccttttttatggctgcatagtattccatggtgtatatgtgccacattttcttaatccagtctatcattgttggacatttgggttggttccaagtctttgctattgtgaatagtgccgctataaacatacgtgtgcatgtgtctttatagtagcatgatttataatcctttgggtatatacccagtaatgggatggctgggtcaaatggtatttccagttctagatccctgaggaatcaccacactgacttccacaatggttgaactagtttacagtcccaccaacagtgtaaaagtgttcctatttctccacatcctctccaggacctgctgtttcctgactttttaatgattgccattctaactggtgtgagatggtatctcattgtggctttgatttgcatttctctgatggccagtgatgatgagcgttttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagttcaattagatcccatttgtcaattttgtcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataagatgtaaggaagggatccagtttcagctttctatatatggctagccagttttcccagcaccatttattaaatagggaatcctttccccatttcttgtttttgtcaggtttgtcaaagatcagatagttgtagatatgtggcattatttctgagggctctgttctgttccattggtctatatctctgttttggtaccagtaccacactgttttggttactatagccttgtagtatagtttgaagtcaggtagtgtgatgcctccagctttgttcttttggcttaggatggacttggtgatgcgggctcttttttggttccatatgaactttaaagtagtttttccagttctgtgaagaaagtcattcgtagcttgatggggatggcattgaatctataaggtaacattcctgaacatccagaactcacatatttttaaaaacactagatgacttaagaagtgcttaaaaaacttggacaaataacatagaagaaattaatgaagttgttaaagatctctttaagatcctgagtcctgatgatttcatagtgaagttttttcaaatattcaagatatttcagatgtcattcaaattagcacagaagatagaggaaggagaattttcttaagtattataataattttaacataccattgatgccaaaatctaacacaagaaaattccagacctgtcttatttataaagatataaaattcctgaataaaacattgtttcatagaatttagcagtgtctttaaattaatgtattctaagtggggttctactaaggaataacaggattattcaatgttaagaaacccataattataacttgtcatattgccaggccagaaaatttaatatctgaatgaattctgaaaaaatacagatataatttcacattcatttttattaaaatttgtacttgagaggttttttttcccctcctgacatcaactaattctgacaccaactaggtatcctacaattcaacttgattctaacactaactacctggcattagctacctggaattagcacctaaactgcaggtttaggcactcagtctcacaagactgtcctcacttcagatgccagtcacaagtgtcaggtcgccaggttacccacacttctgtccaacttggctacaaagtcaagggttgccactccccattccctttaggcttgttaatttgctagaatagcttgcaaaactaagggaatcacttaacttttgtttaccagtttattttggagaatacaaatgaaccgccagatgaagaggtgcatagggtgaggtctggaagggtcctgagtacaggagcttctgtccccatggagctaggatgtgccaccctcgcagcatatggatgtgttcaccaacttggaagctttccgcttccaaaaaatcccctcatttaggatttttttttttatggcagcttcatcatgtaggcatgattgattattaactcaatccccagcccctctttcctgggttgtggggcttaaagttctaggcttctaaccaaggcttggtctttatggagacctgtccccagtctgaagctatctagaggctagtcaagaattgtcttactagacaaaagacagtcctattattattatcactcaggaaattccaagagtattaggagctccaggcaaggaaatgagaagaaggcccagatgctttttaataatgccttggtagttaataaataaaaaattaggtaatcctcattacaagaatgctttatggtgaagcaataaaaacaatcttgttaaatttaggaaagaggaaatgatactttccctcaactctcttatagaacattgttctagagatgcttaccaatgctattagagaagaaaataaaaatgaggtagacatctggcaaacaataagataaaatgcttatcccttgcagaagagattattagctacctggaaaacatgagagaatcaataggaaaattttggaagtgataaaatttaaagcatttggttgtaaatgcacacacacacacacacacacacacacacaaattctcaatatgtcaacagtaagtgattttaaaaatttctttacagcaataggttcatttttttttccctgtgaggaggaatcctgtctattgtaagagggaagattgaaacatgtttagaagaaacagaggagacaaagagcatgtcttggagatgttgatatccttagtgcctgtttttattaagccttaacttcattctgtccttaggtttcatgggatgcctcaaaattcttataataaatcctctttcagcttatagtggatttagattggggttctgttgcttgcaactgtagggagcctaaccaatgaaggcagatttgttagaaagcacaaaacacaatgaactctttgcttccctagtccacaacagttttaggatgcataaaatatagtgtattcagaaatgatgaggggtgagtgcataggtaaatgcatatagacaaaacagagcctgggggaaaattacaataatcttatactattagtctccccttcagtagcatccttgggatcttgggtctcataattctatttccttttaaaaagtcgtgcacatactgtcaacagccattaaacttgcttgctattgctgtcccttgatggcctcagtcaatagccccctatatccttgcctgcatagtcgaggctgttcttaaactgaggactatttaggaggcttacccttctactactagctctctcagctaggaatgattcttcccttatcgtgcttacaatgctcaggaagccaaattcttttaactcagaatcagtccctttctaatctgggacatggctggtccggaatggctagaagtttggagtctcaatcccaaacccaagggtacaaccttctatctcaaagtgttttccaggaatataggactcttggatgatttgctctggcagcccagaattctcaatgtggatttgcagattaggtttttcttcactgttcttcccacaatgatcaggcagtatatttaacaggaattactttacaactaaagaaaaattaaaaccaagacaaggatcccaaagctatataagaacaaaagacctgcttctaactggaagagaatagaaaaattataaaatctcactgtagctcatgatagagtgttccctacctatgagtatatgccatttcaataatttttaatcctttagactttgagtagggcagtctgaatgtaagcatcattttgcattaaggccagcagggatgaaccatagagaggagaaacattattgattgttataagttctcagtaaaaaaaataccctgaccttactctactgcctttccttacatatcttctgggtgcataattttttgtttgaaatctgcaatagggatggaggcagcatattagttatgatttttaatgatgatgcttataattatacagcaaaaaattgagagattactatgtgccaataactttaagtttattatctaattgaataatcacagcaactctgttattaccttccctgttacacgaagagaccaagattgggagcaggtactaaattgtcccttggtccaacaggggaataaggtagcaaatcatgtgaacctgaatggtcagattctagactcctggttccatcctcagatggctgtttggtggccttgactccctggattctagaagcaagcctatggctaatatccatgatatagtttggatgtttatccctgcccaacactcatattgaaatgcaatccacagtgttggaggtggggcctggtgggaggtgtttggatcatggttgtgaatcccttatgaatggcttgggccatccctttggtgataagtaagctctcactctgagttcatgagatctggttgtttaaaggtgtgtggtacctccctccaactctctcacttgctcctgctttcaccatatgatgtgcctgcccccgctttaccttccgccatgattgtaagcttcctggtccctctttagaagccaagcagatgccagcaccatgcttctatacagcctgcagacccatgagccaatggaacctcttttttttttttgtaaattacccaatctcaggtatttatttacagcaatgcaagagtagcctaatacaatccataacttgaagtttcccacaactctagatattctgggcctgcagctactttgggttcatgaacaaagagctgtatttcaggtgaagtattcaaaggagaggcatttccttatatttcagctcaatattttggggtgtaaggccaagcaggtatagacacacttgactgccaaatggggtgttagtaagatgcccttgctcaggacagatctactgatgtggaaagtgtcaaggaaataagaatctttaactaggaatttggctatcattttggtcaaggaagataaattttcagatcataaagggtaaagttaacattgataagacaacactcaaaggtagaagtttatagatagctcaaaactagttgaaataattttagcaagatgagtgatctctgggaaattgcagacccttgaattaatgatgctaattttcagaaatcctagaggagagagatgcctgaagcctggaaactggcaaaaaaaattccatttttccttaagggaagaaaggtgactcaatcctgggcaggaatctagtatgatttatttagggcaagattgtaaacatattggagatcactagaaaccaatattgactcacttagaataagttataggaggataatatcatttcctttttagatagtgtcactaggctctcagagtaggatagtgacatatctgttaggaattgtacttggctttgaataacagaaaccaaaagatgagtggcttaaacagttaagaaattcttcttttttcctgcaaggagaagtctagtagcaggtggtctctagcattgatttcagagacccatgactttcagggctacagtgcctgtgattgtcttgacttctcccttatggttgcaaaatgactgctccacctgccacatcacatcagtatttcaggcaggaaaggcaaagaacaaaggatctgtgtcatctgagctggctttttaaaagtggttttcctgggagggctacccaataacttccatctcattgaccagaactatgtcacatgaccactgttatttgcaagggaggctgggaaatatagtatcttgacacattgcctcttgacaaagccaggaagcataggtgttgggtgctaaactagtaatctctgtcccatgaagcagataactgatctggctttcagcagaacataacaaaaaaaaactttagatatccttagagagaaaactgaaaatacaaatagggtcttagaggatcttggaatactaaaaactagtttacccattcagagcagataaatgaattgatatcattttgtggggaggactttattggagtgcctatgggctctatcatagccctgatcatattagcactttaatgatttgaattgaagacatggaaaagccacttgcgtgatttgctggtgaaataaagttgaaagagaaaatgtgtgaagaagctggctgaaaaaatcagtatctttttagatcttggttgcttaagtgcggccagattttattaggtgaatcagcagaagaataagggagggtcctgtgttgggttgcagaagcggtggtccaagtgcaggatcagggagctctggcttagtgaagcaggtctgtaaggtcttgtgggcttttagctcactcttgactttgtatagtaatcaggatgatgtggatccacaagtcccatttaccctcaagccatgttaatagaaatatcacaagagctgtgatccagggcagagaatgagaattcagtggaaggagagtgtttgacccagagatattcaggtggtacattaacctcttaacttatctcaaaacattttagagattaggggaagtatagttgaaggaagggggcctggggtgattaaaaccatttatctatggaaaactgcaggacttggagacatctgaggagctgaccaaggatagaataagatatccttggagatggtgagttctctgtcattggaaatattaagctgggaagggagcctatagagatgatttaagcattgggagggtaaacagactagttgcactgttacataattccctttggctcatgaggctgtttgattctccaaattttctggtgacccctggggtcacatgatcagtagatatactggtcaaaaagttacatagctgctggcctaaggctctcaagaggctgatgagacactgagcccttccaggaggggctaaaacactgatttaaaaccctgagatgaaatatattattttcaagcagtctataggtttggccacagaaggataaattgcactggaatttgacattagctaacccagtgggaggttgaggggtcaacagaccatcctgtaaccttgagtcttcttgaaccttgggaaaagctggctctgggctggagatgactaggtgtggccaggaccttgattttccctctgcctcattgtggggaaaccatctgtggcttcactatcattagtttacatgggtatgactatggggtgtgaatgaaaagagcacttaagttacctaaacatttatcgagcacctactatgtgccaggcactgtgctggagccagggatgtggagaggaatcaaatacggtccctgggatggaggagctcacagatcagtgatggaggggaccaaaaaccaaacagatcctaataggcagagggtctcgatagacacttataccaggtgcgaggaaatctgttgtaattactcatgcctggaatagggcatcaagggggccttcccaaaggtgagctgtaagtggggaggtgctttagatagataagagcacaggctggcctttcctggtggagggacagcacatgcaaaggccctgttttgcaatgtcctggtgtattctgggaatggtaaacttttctgggtggctggaagagcaaggttcatggtgagcaaaaagactcagcaaatttgggactgatactgaatgccatgctgagacatttttactttgctctgttggcattcaggagtcaccccaggcttaaaagtaggacaaggaaatgatcagatgtatcttctaaaaatcacctcttggttttgtggactggacagggatgaggctgggagcaggaggccagctggacacagggttcctgcatgggctacttctttctttgccaccatcaggctgttcccagattggatgatccatggaaagatatttgcttcttcatcatttcccctttactttcaggacctcatcagcttgggagaagtgctctttgcctgcttagtaatcccatgtagggttatccaagagaaccccagggcatagctgaggacaggggaatgagtcactatttgtcattgtttgccacataccagatactttacttacacaagtcctttcatttgcttctcaccatggctctgagtggttgcaattgtgcttcccaagtggaaaatgatgctcagaccaaactcaaggtctcagaacctgtaagtggcagagctgggatttgaacctgcctctactgactctcagtccagtgctgttggctgctaagggtccctgtgtttgcctccccatggggctgctggggaaggctgtgtgtttgtgtgcacctgaagctgggcagcctgtgtgtctggagggcccatcccacccggaggcaaggcagggaggcccatcagctctctggtggctcccctttgctgtcttcgacctgtctcctgcacagattaattgctgctcacccgaggtgtgatgtttcctggttccctgttccggcaagtgtgggttagtggggagcggtgcagccatgctgatcgggagtctgcactggcacagctggcggcctgcacagcaccctcatcggaaagtgatccatcacccgacagtcgtgttgccatccaggcccagctgccaagctggcatcttgaggcctccccaggtgtgacaggcctcccggctcagagcctcagggctgggcctgcgtgtctgccccttgcaggactttcaaaggggagtgggagccttgcctgactaaggcttttactcttggcagctttggggaaagcccccagctgaaatgcggtgtttccagtggggaaagagtaatttttgaacatagcccctgttttcccactgaaagctcccaagaggagcaagaaccccagaggcatgatgcttcttagcacccccaagtagttccacagagactggtgtgtccctcatatattctcagctgagatggagctggaaagaccaggcagtgttggggcaaggccctgccagactagcaagtgaatttgcgtggaaggagagaggtcgggagcctgcctacgttcaaagggtcctcgcggttcctgctcctgagatttaggtgggattaacttgaccttctagttttaaatcagtacttcttaaatttggccatgagtcaggatcacctacagggcttttaaaaatgcagattgctggccccaaccccagtgttttcgattcattaggattagggtggagtcctacaatttgcatttctaacgtgttcccaggtgatgtcaatgccactggtccagggaccacactttgtgaaccactggttaagggggaggccaaccccctttttaggctctttaagaatttgcagaagtctaagctctcctggtttctttgggttgttagtccctgattaattttcttgtctccccaggccacatgggctgtcctagggctaaaatcagagataaagttcagttccttctgatatctaacaagagcccatgagggtgtggcaaccaaatttggtgaagtccggggcagtggaagcaggatttctacacgagcaatactgatagctataattccatttagatacttgctgttttaattatcctttggccacgaggcctttgagagcacaacctgagatgaaatatacgaaagatctggcttacagaaggtgtttcatcaagcctcattttcccccatccatctctgacttactagtagaggcagatctggatgcaattgagccccagaagaagtttggggaggagagtcttgagaataactcagtagcagttccctgttcttatagcccaccattggctgaggataaaagagatgctctctcctgggtccttaaatgcccccagaggcagagctatcttctggatttggctcctttcacattttgccaatgccaggagatggcctggctggtaggtcccagctggttgaccttcataaagactataggctgctcaaaccactttctttaggcaagatcctcaacttacctttccctctcatttcatctcctggcgtttcatcactgtccagagctgactactagctgctggatgtcttgcaatggcaaagtggtccccatatttttcagaactttgggagggaggcaagggcctcagatacctcctggggcttgaactccctgaaggatttatagatttggttgggagcttcaagttgagtcccaatgatctgtgtaaccataaccaccagtgttccaccctccacttcccacctgttacctaccattttcaagccttgtttccaacactatgcataggcacatgtccaagcttagcttttgtccttttgaattcctaagaggaatcatttaccctgttcttttgtcttagtacgtgtgattctgcaattagataaatagtcctgattccttccggcacaaacataagaaggtacttcaggagaagagacaagaagtatttttttccagagtatttattctttgcatgtattatttgctccctcttatccaagggggatacattccaagaccccagtggatgcctgaaaccatggatagtactgagctctatttttacgatgtatttttcttttttcttttcttttttttttttgagatggagtcttgctctgttacccaggctagagtgcagtggcgtgatcttggctcactgcaacctctgcttcccgggttcaagagattctcctgcctcagctgcccgagtagctgggattacaggtgcctgccaccatgcctggctaatttttgcatttttagtagagacagggcttcaccatattggccaggctggtctcgaactcttgaccttgtgattcacctgccttggcctcccaaagtgctgggattacaggcatgggccactgcgcccggccacgatgtatttttctattcgtaaataactatgataaagtttaattgataaattaggcacagtaagagactaactaatgaataataaaatagaacaattattacaatatactttaatgaaagttatgtgaatgtgatctctctttattaaaatatcttcttatactgcagatcttagcaatctcagcatacaatttttttcttttccctagtaagtagagaacttgcatcttttcacttaaaggaagcacttcatggcttctttttggtgtatctgaattgccagcatcactactcttgtgctttgaggttactcttcagttaaataaaggttgcatgaactcaagcactgcgatacctcaacagctgatctgataactgaggccactactaagtcactaatgcgcagtggagcttatatggatggatatgctggacaaagagatgattcacatcctaggaggaatggagcaggatggtgtgatattttgtaatgttactcagaatggcatgcaatttaaaacttatgaattgtttatttctggaattctctattgttttaagttcaggggtacatatacaggatgtgcaggtttgttacacgggtaaatgtgtgccatggtggtttgcagatcatctcatcacctaggtattaaacccagcatccattagccatttttcctgatgttcttctccctcctccctcctaactctctgacaggccccagtgtgtgtccccccaccatgtgtccatgtgttttcatcattgagctcccacttgtaagtgagaacatgtggtatttggttttttgttcctgcattagtttgctgaggataatggcctccagctctgtccatgtctctgcaaaggacatgatcttcttttttatggctgcatagtattccgtggtgtatatgtaccatattttctttatccagtctatcattaacgggcatttaggttgattccatttctttgctactgtgagtagtgctgcaatgaacatgtgagtacgtgtatttttataatagaatgatttctattcctttgggtatatacccagtaatgggattgctgggtcaaatggtatttctgcctctaggtctttgaggaatcatcacactgtcttacacaatggttgaactaatttacactcccaccaacagtgtaaaagcattggaattttctgtttaatatttttggacctcagttgagcaccactaaccaaagccataaagagtgaaactgcaattaagggggaactattgaaagtgggatgtaatctttattccctgttgcatcccatgcttgcttatggtaccacctaggattgcaatgatagctaactcccaatccccccaaatcattgcatttggctggagttgtgggtatctttgctagctgggtactagcctctgattattttttccagctcttttaagggtagggggatgtgaggcaggtcaactataatggaaaggtcagagtggctggtatagactgcttctgatagggcttatggttagcaaagagagcagtttttacattaactaggataattttttcacaaataatataaatttaagacatgggtgattgcattaatcacttttgctttctgtaaccctctaaagaggacattccacaaggcatggaatggaaagaggaggttacagtgtgacacttgaacttaaacccctactatagagacaggagatagaacattggggcttttgatagctaaccctgagaaaatgcctccatctgccccaggcttgccctgcctgcagccttaggagatggtagccccaccaacctttcctgtgaatttgccagtttctctttgcaccaatgcataacgtcaaatgaggggcccccaccagggtgcctgctgcttgctgccaggcactcctgatgacttcagctaatttctgaatctggaaacattgttgacaatgtgatttctgaaacgtgaaaggcgttatctcattgtgccatctgcggcatgtctgtctgagtcggggcttccgctgccactctgcccccttgcagcacctctcactgctccgtcatcatctcccacagctaattgctccaaactgacaaggaggcttttttcatttagagatacagggaaatggaactttcttgctgatgtttcctagtcaagcatgctttttggaattctaatttgatcttttggttgcgggtgggtgagtggggtctggtttcagcactgggtcagggacagctcccagagaagaaggaagtagcacagtggggactagggtggaaatctcttctgcctgcaaggccgttaattgggaggtagtaaattctctgtcactagaagtgtgcaaatggagatgaatttttttttttttacttgcatggaaagctctaaatggagccagtctttgaatgggtgatttcttctagctcaagggatctcctggagccagttatatccagggggaggtgtgaggtaggggaggataatcaaagggtcagggctagtgtagtagttatccatagctgtataacaaatcactttagtactttaatagcctgaaacaacaataatcatttattttcttgcatggattttgttagtcattaatcaaggcagggcacaatggggattccctgtctctgcttcaagttgtctgagacctcaccttgaggacttgaagcctagggtcctagaatcacctgaaggtttgcctgtggctgaggatccattgcaaagtggctgataagttggtgctgactgttgatgggagacctcagttcttcctccacatgggtttcttcagagggctgcttgaatccttgtggctttatggctgtctttccagaataagcaatccaatgccatttatgatctaccctgggaagtcatgcactgtcgcttctgtagtattcttttggtcacagaggtcagcttgattcagtgtgggaggaaactacagaaatgtgtgaacaccaggagtcaagggtccttgggggccactttggaagctggctattacatctggtaatagagagtgaagcaaggcacacagcttctattgattgagacagtgaagacaagttctgagcttgctcatattttagaagcaggaagttggcagagggcattaagtctaagctaactcaagtttttatgagacttgttctcctgtctctttgcacaggcgtctcccctccagaggcatctacgctgggctttcacattttgcttccagcactgacctttttcttgagcctttgattcatactttcaactcactccaacctctctggcctccatcagcttcttgaatatatcgtgctctttcatacttcagggcctcttcacatgctgttccctcggctaggaataccatccctaatctgtcttcatcactctgtcactggttggtttgtgttcattgctgagatctcagctcaaatgtcactttctctgagcagtctttgcttagctctcctgtggcagattatattttccaaagatggccacactaatatatctcccatcccaaatgctttttttacaatgtgatgttgacatttctccatcaagaggtgggtcagtgttacattatatagaacttggggtggatgtttgtaactgtcacaatcagtagaaagtggcagaaatgatgctgtgtgacttccaaggctaggtcttaaaaggtagcatagcagctacctggagtgctgtctgtcatctctgttcctctcttcccttgtccatggtaccccccaccattttgtgaggaagctcaagtagcacctgcgaagagaccaccgggagagaaatttaggcctccagatgacagccagcattgcccatcgaacatacgactgaatgagagttcagataatttcagctccccagtgtttgagccttccagctgagatcccagacatcatggagcagagataagtaacccccacaatgcatctttggaattccaactaaaagaaactgcaagagataataaaaaatgaatgtaactgtgttatgaactgaatattggagttatttgttatgccatcaaggtaactgatatatctgcaggctccaccaggtttccttataatgtgctgtcctagcttccagtatgtttccttcatagcattcttcaagagtttgcacttatatatgtgacttgcaactaatttcaattcattcccatctgtttcactggacggtaaaatgtatgagggcaagcaccatataaattttgtttgcaaacaccctgctagagcctgacatataatatgtgctcaataaataatacgtgctcaatgaatgtgttaaatggatacatcaatggataatctttctccctgaatttgccatagatgccccaatctctgcacatacgagttgaagacacatctttgtcttcctcttacatcttgatgaaggcaccattacctcttcagatgctcaaaccacaaacttggaaatcatcttggtcttttcccatctttttactgactcccataaaaggttctgggtcctgtgcattctaccttttaatactttattattccacccccatttccccactttagttcagcttcttatcatttccttcttgtatccagtcaattgactcctgttcagtttacttccttccaatgcatcatccaaactggcaggttgacctcttcacactgcatgtctaagcctgtcactctttggatgaaaattgttcactgacattattgtccttacaataatgcccaaagtcctcagtagcctcctcaagtcatttatggagatgggtgtgttataaattgaaactccttgctgtggcctgcagttcctcaatgatctgtcttgagatgatctcttctccctcatctctctttactttcacccccagagcacatgctgtaaacacatcaagatcttgaggtttatcccaaatcacctgtattaatttggttgaaaaagacagaaattccacttgagctaacttaggcaataagagttcattggctcacagaatctaagaaaacttttgcagggaaggcaggcagaagagtgcccaggagtaactagatcaagaagtcaagcagcttctacatatctccagtgttggcttcattctctttcactacagaagagcttttctatgttgcttatttattattgcattaacaagcatttatcattattatctctcatggttctgagggttaccttggcacagccagttggctaatcctcagttttttcatgtggttgccatttgactgatgttggctgcagttgaagtcatctttcttactctcatacctggcacctgggctgagggatgagatagctggtgctcctctgctatctgtctctaccactctgtagtctgtctatgtggtcactctagtatagcaatttcagggtagccaaaattcctacatggtggctcaaggcttcagtgatgggtgtccgaaggaaaaatggcagagggtgcatggtccttcctaacacaaccttgaaagccacttctgccatagtctatttatcaagttagtcaaaaagtgttgcctggattcaagggaggccccctcttgatgggaagggcatcatgtttgaacatcaccagctttgctactggaaacaattcttgagttcatcatcttacagtttcagccaccacttgatcttaagttaaaatcctctggtggggatctctgagcctatcttgtgttgggtgactcaagcccagtggactgtaagagagtgaagtcttctagaaatatggcaactctttcatatggatgagtatggcaggttttgaagtggaggtggtaccaggtaggcagtacagtgaatgatttgtacatggctccaaaatctgaacatagcaccttcccatatttgctcaagctgtgccttcccaggagcaccttttcttccttctttccatcctgttcacttttctttgtccttcaattctcatctcaggaaccacctacttcaggaagtcttatcttttttgacccccaaggttagtttatctatttgctcctctcattaccaaaggtatgcttactttcgttttaaaactaattacactagctcaaaacctacctgccctcttttatcatctgtcttcctcaccaaactgtgagcctctctagggcaaaacttgtattcctagtgcctagttcagggtccagccctttgtaggtgcttgatatttgcttttggaatgagtgaattaatctgagcagtaaggaggctgcccccagaatgaactgctgtgtcctctggtgtgaacatatggcccagctgctgtgtgctggggtaaaaagaggccaacttgccccacagctgcctggggttgagcatctgcaggctgttttgggagctggcctgacagatggaaaagggctgaagtcccccaggtccataagttgctcactccttttgagcctctctgcagctgaagggccattgggcaggggcatgaaaacatctgggagaggaggttgttccaggaaagcatctacgccaggtgtcaagcttcctgcagatgaaataaccagtcctgggctggagtttctgacatctgctcgtgtgagggcttgaggtcagggggccctgagagatgatgctgagaataggcttgattgtttggagcaagtcccccaaatcagagatttagggactagacagacataataaaaatgagagtggccactgatggagtacggactatgtgccaagcaccatgtcaagctcagtgcttgtgcataaactgcttttaaccttaagaggcaggaactcctattatttctattttataaaagagatagaagttccgagaggtaaagtaacttgtccagaggcccacagctcaaaaagggtagagtcggggtttgaatctgtgtttctgactgtgtgagctcaactccactcatggtgctctgattaaaagggcccagactcccagtgagaggtggtgaaacagactccttcagatacgggttctgggaggatgttggctaagacatagagtctttatgtttctgggtagttgggcccagtagacttacctctgctccccaatatagaccgaagccaaggacttgggtgcatgtaatttttttttttcaggatatgactccaggaagcacagtaggaagtgtgggcatgagaccaggaaaggaaggcaggcaactaagggtacactaatgagcctggtgggacaactgggctgagactttctgaggacctgtgtagagctcaccttataattgttccacagacaggaaggaagctgagtgtttgttcatctgttacagtgcctcattggttgagggttgtttccaggggcaagatctccctggctgtttccatctgatcctctttatccaacatgagctgaacctgctccagttacaaaaggaagctctcaggcacagagatggagatgcttggggtaggaatccattggtaagtacggaatctgtctacggaagctgcaggtgactttgaggttgcaccatagtgatggggcaagccaccaacagtgtctgctacactagccctacctgtgaatgcccctacaaatctgtccttcctccatcaggcatttctgggtgctcccgggaggtatcttatatgtgttcttaatcttgatcagttattgcttcctcctctgggtcgtgctgggcactatcattttccccagccctgcaaagacaacaggtgctgtgtcattctcattctctgagtattagtgggttctttagactctcattcccagggaatatctgctgcttgctgggcatttccactacatctgctaccttcaacagtttttcttttaaaccatagtcctctcttttcctcatgtagaaaagaggcctcttgggaggctgtggtgggaaatctgagagacaaccactgccatgttgtacttgaaataccccagacctctgattggaagtcaacagcagatctcttccctttccttcagttctagcacagtgagatgcatgggcaggggtacagatggttcaggaagctctaagcctagtgaattggttaggaaaatccccagtacatttgttttgtatttttcttcaaaatgagggagttggcaacaaaacgtgtggaaaagtcattaggttagttcatgcctcattatgataacttaggggttttcagaataattccttcatttatgtgatgaatattggttgagcacctgcaacatgccagataccatcctacttgttgcattgcatgtcaggcagggcaggcaaagggtgacacaatggactctgatcagacaggaaggcaaggaatctaccagcaggaaaagataaaatctgaggtacatctagggaaacatagtataaagatgaagttcaaggtgtggctataaaatcctttgcaaagatctcaggaggattgaaagtggtgcctcagagagccatttagtaaataaaaaagggctaataagaaaattaagggtatcgtctctcagcaatctcagcagtatcccaagatagacaaaggcttggagatttgtaagcttgtcctttgtctaatgacatgaaccctagtttcatagtagaaccacaaaacttttaagggcaatgtattggcagaaacactgcctgctaggactgaaaggaacagaagtagtacaagatgaaaaagggcctttggacccctgtctatccctgaaaatctctgtttgcagagggtaagagaagggaagcacagtcctggcctctggcctcacttgggagactgtttctgttccctggctatgcatgaagaatgttcagcttcccattctcctgtagaatttgagctcttcacccttagtacctaattatagttccagtgcctggtgaaccttgagcttcagcctgtctcagaattgtaaaattttcttgcatcactagtaaagagatttgagtattatttctgagcatgatcatggctattttaataatttaatgtactttatgtgccgtttctatgagtttgggaaagagaacagatcattctgtgacctggaaagcagtccactagtatttaattttcatatctcattgaattctcactataaccctgcaagagtactcttattatcttcctcctttaaatgagaaaactgagactcaaagagattaagtgtcctattcaaagtcattcatatagtaagtagtagttgattcaggattcaaacccaggaaatatgacttcggagctcatgcctttaaccactgctgtatatgacagaacttctcagagcctttaatatgctggtgggtattattaatgtccaaaagtggttatgcagaatttcccaaatttatcttaccctatcccttttgagtttcttttactactacagttctaaagacatactttgtgaaatattgcagagattgagcagataaaacttgagaagttattgaagtaggtgatgtaatagtaagcttttgttaaatgaggccatggtaacaaattcttcaaatatcagtgctttatcaaacaacaagattttatttctctttcatgtcacatgttagaactatagtttggctgcaccttcgctcaatatgtctttcattttggaacccaaggagaaggaattatcctaatctagaacataccatcttcatgacagacagaaagaaagagcaagagatggggtagaaacttgcaacacatcttaatttcatggatatggtatatgttacatttgttcacctgccattggtcaaagcatgccacatggccaaaaacaaagtcaatgagatgaaaatgtgtacttcctttactgacaatagaagggtaaataattccaacaataatgcaatctaccatagaaaacagaaccactgagagccctcaatcaaacaggcattttcagtagcagagaggagggaagttggaagctgtactataaagattttaggaaaagcacaggaggtgtgataatatgagacaagagaaagcatgtggctgaggatttttatggtttcatgtggctatgtgggtgagtaacagagtctgtccagcatgtccagcctaggacataggagaaatgtgagggtacctggatatcctgtctggtatcaacacctgccagccacccatgttagagatgtgttgctggttgctcattcttatatgcctcacacattctgagagctctttcaatacagtttttgaaactacttatatatcttcatttactttccttccccctttcaattgctccctaatcagcagtggatgatgtccaccctataacctgaatgtgatgtcatctttggtatcgtttaagaaatagcacttaacagttgttaactatgggaatccatttttagaacactgcttatcttctccttctttacaaaggtgattaagatttatttttacttggatgaaaacagccttcattgatttctgccccatagagagatgacaggacacttgcattagtcagagaggaagttaaccctttacttactgccactgaggcaggctacacaattcctcccagggcatgtacagtgggcaaacagagtcaaaattgtcttgttttgtacagaagcagcaaacccagaaatcagagaatgtgacttctctgtgctcagtatggaggcgattctgagaattccaacttgtgggaagctttcttcctggttgactaccaggggagagtgtgactgactccaaaccagctctgtgagccttcctttcttttagtatgagagctgtacttccttcctctccctcacacacaccctggtacgtctgcattctgtatccttgtatgacagagacacttccacatttttagatgttacagcaacaccctacttctaggtaccaagatctatattgcttatctcatacttggttgctgaaaccaacacaaatttattatcttatacttctggaagccagaagcctgagatgggtcttagggggctaaaatcaaggtgttggtggggctgcattccttctggaggctctggaggagaatccacttccttggctttttcaccttctagaagctgcccacattctttggcttgtggccccttccattttcaagtccagcaacaatggctagtcaagtgtttctcatgatgccatctctctagttatgattcttttaccaccctctccccatttaggaacccttgtggttacattgggtccatctggataagctaggatgataatcttatcttaaagtcagccgattagcatctttaatttcacctgcaaccttaacttctcccttgccatgtaacctaacctcagaggtcccgaggattaggacgtaaacatctttgggaggctattattctacctaccacaacatctaaatcttttgcccctgtcaactctgcaaatggagatgggttttaacctgttcagagatctctagggggtcagggacataagagaaatatacagtgtatcacacaaacaatttcaaattaatgttatgttactcttattctaaagagttctttggaccctgcaacaatgtgattttctcagctttgctttctctgtagctcccagccacctgttagattgatggttaatattttcgcatcctgactcatttctcctcaattaaaaaaaaattcacaatctttctgctctattatgcagagcaatttgttttcttgagtctttatcttagctcactgatcatgtctttaaatttttgatagtttggcattaatcttgagttttaaaatattgcattaagtattatttatcttggttattgagttttttggtgccctttaaaattttgcacctgagttgagtgcttcactgtagtctgggccctttactccctatacctgcctcaccttgtccccatcacactggtcagaggcagcccctgctaagaggttcttatgtattattcaaataaagttccatgcatttagatatatctgtaagtctgagttagacatcagtttcacacaaacatatacttattattccctgttctgcaactggctttttgcctcactcaatgtgttaaaaatcttcccaaaaggttgatatattatagctcagcattatgcttttcttttttttttggacggagtttttgctgtattgctcaggttggagtgcaagggcacgatcttggctcactgtaacctctgcctctgcctcctaggtcactcctaggtctgcctcaatcgctccttgaagtgattctcctgcctcagtctcccaagtagctgggattacagatgccaaccaccacacctggcaaatttttgtatttttttttagtagagacgaggtttcaccctgttggccaggctagtctcgaactcctgacctcaggtgatccatccgcctcagcctcccaaagtcctaggattacaggcatgagccaccgtgcttggtctgacatcatgctttttaacacagctcagaattttcacttttgtgtattttcctaataatttgtaatgacgttgtattttttctatacaagaaaacaaaagaatatttaaaatagtagtgaaaagaatagttacatttattgagagactatttaaagtgccagtactatttaagttgttatgcattatcttattaatcctgttggtaacgctgtgggataggagtcattattgtaccttacagatgaggaaactgagatttagatgaattaagtaacttggctcaatatattacatccagaggtggtagagccaggatttgaatgcggatttatcttccttcaaagaccgtgcttttaaccacactctttaatatatcaaagtatttaccaaggcctattctttaaaagacccagtagaagccccctgagttacattcagtgatgagaataacgagggcctcatgtgaactgttaaacaacaataaacttaacagaggacagagttatgagaaatgccatgtggggctgactggttaagtatcccaggagtggatcggatacatttgcttatttttccagagttcgaagggagctgtgtggattgaacagttagtgccagagactacaaggtgcgtttaagatgctcccaggacaagcttcctttgctccatcttagaacagtaaaagttagctcagtctttcttattcggtgctcctctccttacgtgagattacttacattcctcattctttttcctggcccagtactagattctgatattggtttctggctgtaacagtcataatactttgatttgcaaataagagaaaagtcaatttacattagcttaaatatcgaaggaagtttcttggcttatgtaactgattagttcagaggtagcatgcttcaggcatggtttgatcagagttctggctatgtttcattgtgagttatctgtgctggtattgtaatgtgtcaactggctaggctggactgacattttcagaatttccttttctgcatgcttcttattagggtagaccacaaaaggtattttcaggtaagataagagggtggaaatgaagcagcagtcatttttgtttttgacactcagaaggtcggagcaggcatatggagtggggaaagtatgccagttaacctatttcataatcacatgctctatcgctgttcctgaagctatgccaaggtagctgggtttggaagtgtttccagccttggtttcatgttccagaattgcaaaacttcaagacaagtgttaacttgggccatgaacccaggctttctcttctttctggtgaatcttcttttaaaatcttgttgtccttacatttttttttctattaggcagaccatctcggtcaactcaaagttgttctagtgttgaatctacttcctaggttcagttcaggatttcaatccccttcctacaaggtttttagctccttggtagattgattcatttctcccttacaaagatgtttctgcactcctgggagctttgggaaagtacattttgtcgggtgaggagaatcctctttattcagggttaagtgtctccttggacttaacttgcataactacaagggacacccaagtaactcccaagaagtgagaaagcagagagctgcagagtgctttgctggtctactttggcagagaagagtcctcagctgctttcccgagagaatttaatttaatttctaccttaccaagcaaccccttgtatctgaattgactgtgtctttatgggatgatctctcattgcacgccctgttgatgcccacgaggttgtccctgggatcttggacacagcctagagtccctttcacatacatgtgaataagtagagtgacattcattcaataagtataagttatgctagggaagccatagggaagaggtgagcttggaagaatgggtaggattttggaagaggagtaataaggaccttgaaaaggaggaatgacatatataaaggcataaaggtgagagcagagaaagttccagttcttggggaggtgatgaatctggaaggagaggcctcagccttggccccaccactgtttgtggggccttagtagaggatactcttgtgtgctgtccagtgacaaataagaaacaagcctggatttttttttgttttttttcctgagacagagtcttgctctgtttcccaggctggagtgcagaggcacgatcttggctcactgcaacctccacctccctggttcaagcaattcccctgcctcagcctcccaagtagctgggattacaggcgcacggcaccacgcccagctaatttttttggtatttttagtagagacagggtttcatcatgttggccagactggtcttgaactcctgacctcgggcaatccacccgccttggcctttcaaagtgctgggattacaggcatgagccactgcacctggaccaagcctggatttttaagtaaggagagactttgttcagctaataatgtatgagtcaaagagcgtgaatttggagagcctttggccttgtcataggtaaacaaggagagggcacctgtgagtcttacctaagacatgtggggcagggtgcaccattgcaataatctattttctgggacaccaaagggtgggagattttttaacttccacattttccaagatcacagggcttggataaagttcaatattgtcactggattctgatggatcccttttgccgactctgtgtgcccatcccccagcttttgtgggctttgctgctgactgctcactcctgtgaccctcttcagagggttgcccttgggtgcagaagcccataggggtggggataggttcctccatcacagcctgaagtgcctgggactttgttcccaccattgtcatgactggtgtgggagtacaaaggcctagctcctgtgtccaaagctggacacagtctaaggtgcaactcactccagaactccatggaggatgaggctggggctgaaacttctccgaaattgcacctttgttcagcttctttcctttttctatgttgcttccttcattccctgactggtttcttcttagagcacttctttgacaaaccttcctacgctcaaatcttcagctcaggctttgcttctgggagaactcaacccaagacagcttcaggtttcccattggtagaatggaggccttgggatagaccactggttttagagctttgctttgactacagatccctttctatacatgaagatctatgaagaagtccagaatatcaaacaggttagaatggaactgctgaagttgatgtggggcagtgtccctgcatcccctcctcactattcccaccccccttctcaactttggtagcagtcctgctctaccttgcagatgctacacccccatcccaccttcttggggctccatgggcacagtgcaccagctctggactggatggtaatgtcctctagctctagctccatgatatccttggcatcaagtgacagcaattgttgctgcagacttcaggtcaggagtggccttgcatgctcctgagcccaaggtgctcctgatggtactgccagtgtcctcactggggcattttatcctgcatatcctcctgaaaggcaattttatcctgtatatcctgcttctggccaatccagtagccccacagtcttctctgagaccttgagtttgcaatgaggttcccagagactggaacctcacagagttcctggttattgctttgaatttgcacctgtggatttaactcctggtgatccaaaggcaatcaactttggggtggaacttcatgagttggcttcctaggagagaattggcagtggcagctagaggaagtgtgtgagaggctctgttcagcagggtgagcatatgccttgctcattcgaggcactgacagtggcagaaaccaaaggaaaggagcagaggcagagtggcttggggcattacaatgatccgtgcagttagatgtgctcggtgttgatgctagacgtgctcctcccattgatgatagtggcaacaacagtactgatccctttaacattattgaggtctattatgtgccaggtattgtgctaaaaacacctagtctttatggaagtcttgtgatgtaggctctattcttactcccattgtacagatgaagaagatgaggcataacaatttgtgcaagcccacacagttaatgtgccggagtcaggctttgaactccgacagtctgactccagaccacctcttcctcccagtatccatgctctggtgcctcctgtggcacactcagaagatggcctgcatgtgcatgtgctcatttctgtgtgtgtgcatgcatgcatgtttatgcaggactgggaatgcaggggagttagagtccagttaggaaggagagaggaaatatgatctctttgttgcatgtgggcaccgtaactccagccaggcaaagtgctggtctgttgtagctcatttttatgtttttatttagaagcttcaataccagagctgatggcagaaaatgtgcagtaaaatgcggggaggccgctgggtaatggcccctgtaaagtgttaattgcctattgagactgcagactttgtccatgctccaggatctgaactattgacaggttctaatttatttcgggcccacaaagcgggctcctcctctaaacaggcttccaatcagtcacgcttccctgggcctgccaagaagctccagtcgataagtatgtttgctgccttaaccctttgaagctggtcgtgtggtctgattctggcttgccttaaggaaacttccatgcacaatggtcttggatgaaaatccatgagaatcaagtgctgactccgtgctgggctcccagctgggtgttttacatgcattgtctctgatccttaccgcttagagaagcaggtagtatctcttcaaggacatcctaacctcagagaagttgaattaattgtttaagtgaccactatgattatacttcagactgttacgggctaaactgtgttccctcaaattcatgctttgaagctctagctctcagtaccttggaatgtgaccgtatttgaatatagggccattaaagaggtgattcagctacaacgaggtcttagggtgggccctgatctaatcttactggtgttctttcaagaagaggaaatttggacacagataaatacagaggggtgacccactggaagacacagggagaaggcagccatctacagactaaggggagaggcctcagaagaaaccaatcctgctgacaccttaatctcaaactgcaagcctccagaattataaggaaatgaattcctgttgcttaagccacccagtctgaggtattttgttatggtagcccgagcaggtgactacacacacccaggacttggtgtggccttgaatttatgcacatgaccactgtaagtatgaaaactctgttctctggcttatggctccagttagaataagaagcagaaagtgggcaatattacctctttgcagtaaatttgttcttaggttgggtcctcaaagggcccatgcctatccattagaaagaaaaagaaagctagatttgggattctaagtgcaaaaagaagtcattgactgtttctaagcagagtcagtaacacaatcagaatttctttctttttttggaaaaaatagtctcctctggctactgtgcatagagaatggatggtagaacacaaaagtgaagcaaggagaccccagaggaggctgttgcactgcaggcaagagatgaaagtgacttgatggagagtggtggcaacagagaaggaaagaggtgaatagatttgaaatagatttttgagatggaattgacagaacttgctgatggattgggggtggaggtgagagggagggagttgacaagtgatgatgctcttgtttctggcttgagcaacctcgtctttacaggagctatttatgaggagggaagacatgaagaggaatcgattgggtggcaggtgttcactttctttaagtgggctgtccactggaacataagctctgagagggcaaatttattgattgaaggttgtatgaatctatttattcctgtccccacatttcatgcacacatatggtttttatatgaaccagaaataatgtagtttcttttttctacatcagaagcagactatattttatgtcaagggtgacatctaattttgctagtctcactctgttgcccagcctggagtgcagtggtatgatgtggctcactgcctgccgcctgaaactcctgggctcacgagaacctcccacctcagcctcccaagtagctggaactacaggtgtgaactaccatacctggttaattaaaaaaaatttgtagagatgggtgtcactatgttgcccaggctgttcttgaactccttgcctcaaatgattctcccttcttggcctcccaaagctcttggattacaagtgtgtgccactgtgcccagccatcacttagcataatgtttcaaaggttcatcaacgtttatcatccactgatacatgttgtagcatgcataggtacttcattcctttttatggttgaataatatttcattgtatgaacagaccatattttgtttacccattcaccagtttttgaacatttgtgttgtttttaccttttggctattgtaaatagtgctgttatgaacatttgtgtaaaaatttttgtttggacacctgttttcaattctttgggggtatataactagcagtggaattattggatcatatggtaattctatattgaacttagtgaggaaccaatgtaaggcatattgatgataactgatatgttccattttggaaagaggaaatggaggcccaggatggtctcaactaccatctaaacatcctcaactctcagctctttaacttcggtccaaatcttctctgtggtctttagcccatgtatttaattcctggtggacatttctacctggatatctcatagtcacctcaaactcagagtgtctgaaaccaaacacaccaacttcttccgtttattcccataacagcttcatttcctgttttcatctcagtgaatgacaccaccgtccaatcagctagcagtgggacatcatcgttggcctgtcaagggatggtactatttactgtgtgaccgtgggcaagccatccatctctatactttagtttccttgtccagaaagttagaagataatcttactggggatgagtatgaggatcaagcgagatgactctctctctctcatctctacccccatcttagcaaagtgtctggcacacactgtgagctcaacactattaacatggaactgttttgggtaagatgtgttattatcctgtggagctggtgtttcacagaacagagttgagggaaatagtgaactgtagcaatcattttcaaatgtgttcttgcaactggcagcatcagcagtacctccgctctatggaatcagagtattgagggatagagcccaggaactggcacaattaaaaaatgccccaggtgattttgacactcagccaagtttggaagccactgaattcagctaattacattctactatcagtaaatacattagaaacattagtaatttcaatcaaacatgaatttcactgttttcctccccaaatctaataagagcatcaatctttgatctttcaaataggtctccgtttcttctcactattctgttgaacttgggcagccttttttatgtggtccccatcagagctgtcctttatcaagttgcattttgctctcaggactgacagcatctggacattaaattaaaaattacttagacatactattggtgataatgttgggcactttgtgactcacctcatactgtcgtccttaggaaaactgtggctagtccagaccaggcataggtcttcttgtggagggcatagatcagaaagcattagagatagaggaaggtgttagctagtgttctgtatacaaaggagcctgtaggacacagtgttaagcaaaatgatccagcttccttttcttcaggacttctcagagccttgaatatagtagtggacactgactatcctaaagtgcaaatgaactataactgcaagtagcccagtctggacaaggagggaggccttccaaaggacacagtttctaggtggttagttttggacatcctgatatatcttgtcaggggcagcagcaaagctttggggcagccttcctgaagatctgagctgaggaagggtcaacgtggagaagtgggtgtgaaggggggaaggttgttggacattgagatctatccattgatctattttgatcaatgtctgtcaatatccttatgtcctgactacctggttcaccctctggctctgaaaagaaccactttggtttctgatgttctggaggcccaccagaccctctaatgacctgagcactgggtctgtcttcctggcacccatcaccagtgtcacatatatgtcccagccacaccatccatcatgtcaaattgtatgtacaactgtcttctccattatgagctactgaaggcaggtcttgtgtctttttcttctgtcgcctcctagcatagcaccaggcacactagttgtgttgattagtgtttgtcagttccataaggccaccaggatgctctgttttgtaggaaaggaagagaggcagcaggaaagcaggcaaggcagcttatacactctcagggattggaaggaatcaggagagggctccaagcccctggggctgcacagcccatttctctgcagattgccaccactagagagcacagtgcacctaggaacagggtctgccgagtgtctggctctggcccagcccagctctgctcagccccccacccctcctggcaacactgcaatgggaagcaggatttggatgaggctcagccctgcctcagacactttgcaatcttaggcctaattaaaacaccacagatggtttgaaccccgcattaaaatttgatgaggaattgatcagccaagcaaacaggaaatttagctgtgagtgaaggtaatgtttgctcaaatgtgtaatgaggcccacggggaatatttgtggggacctccgtcatgtctggagtggctcctgctcttcaatttcattttccctatttgcctttcccctcaaaacatcccaagatgcttccagaggggaaaggcaacacagggaaagttttagtttcataagaatttcctttgaaaacccaaggaaatctaaaatcctcaactatgtactggaaaaatagcacaggaaagggccagacttgggtgggagtcctggctctgccatttggcagttggcatccttaggttgcaatatctaattttatgattagtcactgagtacctactatgtggcagccaggggttagatcctggggatagacggctgtgcagaactgtcttggttcctgcctccatgggtaaacagctgagtaagagaggctatgagtctcaattttcttatctgtaaagtgggaatatttgtatgttatcatagggggttgttggatgaattaaatgagaacgtgtatgcaaaacgcagagaacagggctggaatacatgtgtcaaatgaaggttcctccatgtccttcttccccataacctgcatctaaagtctatacaaggcttttcagctttccttctacttaatgtctctgaaagtgacctaatatgatattcactcacttatatgttcaccactggtgggtgtaactgaggccaaggacacagcaagtcacaagactaacctatttaccagattggaattggatcagaagttctcttagaaagagatgaaatagcaagcattcttgggtcatctgggatgagaggagtctgatttgagaacgttgctccgaggattagggagaaacatcagaagcttaacgtttcctttagacacatccgtgataccttaagtgggagaagagaggaatatggagagattttccttcctttcacacatccacgaagatactttaccctaatagtaatgatgtgtatgttgtgtgctcagctttcccttcctcttcatcatcccgactcccaacccaatgcccacccattgccattcctatccttatccccgattccatccccacacccatcctcatgcccacggttacccattcctattcttatccccactctcattcccacactcatcctaatgcccactgtcacctattcccattcctattcttatccccactcccattcccactcccatcctaatgcctactgtcatccattcctgttcctattcttatctcccattcccatggccatcccaatggctactgtcactcatttctgttcctattcttatccccacacccatcccaatgctacttatccatgaccatttctttactcacctctactcctccccatcaattttcttccctgttaccaacatcattaatattatcaccagaatctttatcacaaaatatccccgtcactggtttggtaggtgcaaccagatttgatttccctttcttctactcataggatcttacataagttgatcatgtttgttaaatttctaggataacccccttccttaattccaagatgcatgcttccctgtctcacatgttttaatgtctttgaattcagaaggtacctcacaaaaaaatgccaaaagacaatttctagccacaggtagaagaatgagctgtgacagtgttgttattgctttgacattgcaatagactgctgaagtttcaaagatgggagagcctgggtgaccaatttttatgtcctggagaaccaccactcagatatttacataaggtctaaggaaagcaatggctgatttccaagtgtccgagtttcattaatagggaatttcaaaacaagggaaaaaacaaaagcttgagtttaatcaaataggaaatgaggacaaaaccttggttttcttcaatatgtttcagatgatgatgttacttctaaagttcttaaaatacagagcttagaattaggaaaaacaacatggcaccctgatactaagggtaactgctctttgagcactgagtaattgagtaattttcaatgactttgctactatggattgaatatttttcacttataaaagtcagtgaaagtctgggaaagtatagatttatatacatttattttgtatcttgtcatctaatgagatataataaattcattagtttatcaaattcttgtattatgttttctaaatttacagtaataacatttgcaaatgatacctgttttgattctttattttcagtagttaaccacttatttctgcctcctactttataggccagagcttccatcagaatcagtgtattcagatttcctaatattatttaattaattttggtcattataacattgtgatttttctaggaaattacaggtttttttttaaatcaagaccattggtatatagctgtgcagtattttctgtattaattaaaaatttccctcatatttactttcatatccctttatccatttttaaatttatgtaacccaaatgttacagtctcatgaggtcagagtctcattaagaaaaaatcctgcattttgaaggttctgagtttccatctgactgggtccatgtatcagtcctccttatttcttgccgctaacatcatgcaggtgtaagttctattaattttataatcccacttcttaagggtaaccacaacaaacattttggagtagaaaacatcagtcctttttctatacatacacaatatgtgtaaatataatttcatttcttacacagtggggtcatattatatattgttctgtaacctgttttttaatgtatcccaaaatatgttctttattgacttcataatattccacaatatgggtgaaccatatgctatttactaatttctttgttgtttcctagtcaggttgatccatttgtttgccaccgtaagtcatattatgatgaacacatttgtgaataaatatttgttcacatttctaattatttccttaggataaaattgttaagtaggcatgaataatttttcagcatccttgatacagattgccaaattaccctttaggaatttgtactaatttatactcccacttgcaatcgatgagtgcctagattgctcaactgtcaccaacattgagtttctttaatctttgcaaatttaatagattacaaatgaaatcacattgctgtcttaattagcatttatttgattattagtaggatgaaccttttaaatctttgtaatttatggttcttctcctccttttttgagacagggtctggctgtgttgtccaggctggagtgcagtagctattcacaggtgtaatcatagcgtactgcagccttgaactcctgggcccaagtgatcctcccacctcagcttcccaagtagctgggattataggtgcatgccactgctcctggttatcattcctcttacatgaactttctctgtctgtccgtggatcatgtttccctaactcagcgtttgttttcttactgcttttaagagtgatctaacccgtaaccttaaggatattaactcttcatcatacatgttggaattttttttttctcagtatgttgttgaatttttaatttttatagttaggtttatcaatattttttgaaatttatttcttcgcttctattcttagtgaattctgtgattagatcaatattgatttcagttttctcccagaggctgagctgagtttttggtgggtttggcacagagctccttaccctaacctcaatagcagaacaggcctcctttattgggagagggaatcctctttgaatgagactgcagctttgggaaggaggaaaatggagcagctatgaaagatggtttgctgtccagctcataaagtcatctggctcagcctggtgatcttggggtggcatgcatcacattctcagccccgtctgtctgagcttctgtttccttctttcatgtaaatcattaatctaagatttagttcagtgcatatttgagatgaggctctaacaacatatacaatatacaacaatatatatcaacaacaatatgtattattaaatacatatatgtcatctccctgaagccctacaagagcctaatgagatagatggtgatataatttatagaataggaaactgaagttcaggggggccaggcattttactcaagaactctgcctttgacattgacccaaatactctgccttggttagtccactggatgcagttgcagtaaagagctgggaagctccaaatcccacctacttgattgtggaaaggtcagtctcttccatgcttctgctttccaaatggcttgggggatttctagagaagcttccatgtgttcataaatcagtcctgttgtcattctctccttttccagataaacctgggatgactacgccacaccctgacattacagcatcttgttttatctccctgagagtgctaccagcaatgccacctccaagtgtagctgtttcaggtgtggaccctaacactggattcgtgtacccagctctgatgctgtcatccctcttgtggagtgagtaaaaggactttcctttgttatgggatgctggatgctgtatgctgtggttagttgcactgggactttgtaatttgaaggctctgttgcagctgtgtgttcctagtggtttcaaggtgcatctcctttaactatccaggcaataatggttccaagaggtgacaaggacaaagaacacttcctccttctgatttatgctcatttgatgaatgtctcattgcaaaaccgtccaggctccaaaaatattttccagttcttattcttagattttaaaactttttcagtggtctccctcccttcctacttcctacctcccttccgctctccctacttccttatccctccccgcccccacacagcttcccaccccaaatgctcatattgcaaatatgcaaataacaattaagattccgggttataaaaacagaaagaaacttcactgcatttaggtgaaaggaaatctgttggcaggatgttcgggatctcagaattgttaggcatcatggaccaggctagctaagagctctgtagatatatgaatcgggactcccagcaattgttttatggaaagaaggatctggttggggcccctgtgctatgcagcaatgaatggactctagccatttctttccacctcttcctttttctccctagattagaagtccccatggagagtgtaagccttctaaccttcctccacaagcctgcccctactcctgactgtactgggctagaaggaggaggatcatttctctttggtgtcccaaagttgaagtggtcacctctaataaccctcccaccaaagatatgcacaatgaagagaggcagttttcttagaggaaactaaagagaagtaataaacactgggtagcagctgctgcttccacttgccttggagagtctctaaaccactgacctcttaaatctttgctgagaagtggaacaaaaccatggtggggatccttggtggaaaatcatctattgcccaaccaattgggctggaaggggaagtttaggtcaagtggaaggctggaattagcctcatccatctacatggaggcagactcccttcatcccttaggcattcaaggctgtgttggcctctttatttttgtgtctcttccttctcagcgtttgttctccagatcatgattcctccctgccccctggctttattccagttcaccctagtctatcatacatttaaaaaaatatccttgaacctcaaggaggattagagttctgtttttattttataggagggtagggtcttagttcacatccttctgagaggaggagttggatgcaagctcatttgtttatctggaggatgatcccagaaaatggagaagtagggaaagaagaacaggggaggagaaaagccaaacaagccaaacaagtggcatgctggtgagtgtaagattatagctgtgggccacttggggtcaattctgctggggacccactgaaatagtgtgtggtatacactgtaaagtcttcccactggaggggggaggctgggacatctatccactgattcctctaccccatcatttggagattgcttctggggacatttgtgcttgcagcaggtcaacacactcaaggagtgatagataaagcccttaggcagagaagaaagacgtaggaagaggcattagaggtgggaagtgccagtgtcctggaaatgtttccatctgccactgcaggtaacccaggtgggccaaggggatattaggcaggatgtcaagagcatctgctacagagcaggctcttcatctactatgcaaattagtggattcatctctgcaagaggctaagtactgttacaagaaattgatggaagaccccaacgtcttatcagttttccacatccaatgggctctgtctactctaccttgtccctttttattactttgtgtcaaaattattgtcagaaattaaggtcataaataggtagcttaaaaagtttacgttcacatctattcctgggatcacacatatttcgtgtacttctcactcagttctttaatttctaccagattaatacattgccataaaagcagcttccaagtgcagtaataatcacaataatcactgtaaaatgtaatagataattatattgatgaagaattatatttagccatatgccaatataagaatacttattgattcatgtctatcattgttatcttctctctagcctttaggctatagttacctgtcaggattagtagtgagaagtctttggatggatttggaaggtttgtctgagccctggcaatgggtagggtacagatgactaatgtgaatggtctctagttttgttctctctacaaatgagctatgggacctcaataggaactgcacaacttgctttggaaattgtctgacttgcactggtatttttggatgacagttttcccactgttgatatgcctttctctttaccagcctttgttgattagaaccatgcagcaagaaaactcatgcatcactggaatgctccagtagagagcattcagcattgtgggttggctaattggttgggcaatagttgattttccaccaagaatccctgccgtggttttgttccacttctcagcaaagatttaagaggtcagtagtttagagacttctccaaggcattgttactttgacaagatgtaccagggtaattgattagtttgcacttgatattgccataaataattacaacaaagctatccttatcaaaacaaatgaaccaagcagtatgtctgttttgctgaaccccatgttcaaagggattagaaagatttagaaattaaccaaatctgtctttgagacactgcccctgaatgagagacagagtattgattaacatcctggaggaaatgacattgtaaacagctctggtttaatgaaacatggtagggaagtagggtagcaagacagggctagaattctgaccctccacttacaaatatgcccttaggtaagatttttgcttggctttctgttaccccattgatgagataggataaaaatatgaatccttcaggagtatcataaacatgaagtgaaagaatgtatgagcaaacactttgtaaattcaataatggcatgtagatgttacatgctcttgctgttaaatacgatatatagcccacttctttctacccctttcctggtttctctctgaggcagagattctcagcctcagcactattgacatttggagctggataactctttgttgtagagagctgtcctgtgtattgtagaatgtttggcagcatccctggtctttacccactagattccagtaacagcctcctggtcatgaccactgaaaatatccctagatgttgtcatatgttcatgggggcaaaatagaccttgattgaggaccactgctctgagtgtagagaagttgatgaacatttcctggaaattctttggaccttgcctctttactaggggtggcatccctgtatgttaaaaatgctcacagtcattctttgcaaaaattaattccaggagccggggtggatatatcagctcagcctaagttccactgtggtaacaaacactgcccaaatctcagtggctatgtaaccctctcctaagaagagtcagcccaggtcacatagccaaatccaccctaagtgggatggaagacatagaatttttccctgcaaaagatagtgaatattttgaagaataatacaatctactaccaggagttagttggtagaacacaggtcctttgtagtctacagatattgccatttttctcacacattttcctggactgactttttccaggtaccagccagttacttcttccaggtactttaggccccagctaccagctggcaggggctcagtctccatgccttgggtctcttggacttctcttctgacctgaccaaagctccatgttggggtattaggcacatgtgcagctgatcatcaagggaccgctttgattctcctttgcttttgcacacatttatggctcatgtagaaacttctcagaaagagccttctaagggtttcaggcacagaggtggctaaatagatctgcaatctgtaaagatgttgcagcatgcttggttgaaaagtcaagcagtcagttagtcatttacttggagtgttaatataatgacagtcacttggttgagctgattttgtcacttaactgctggagactgtctactgcttaactaaccagcataaccttcctccctggtgacacagctggagtgtgtcagaaatcctatcacttcagtagtgggactatggaaatgaatcttatagtggggctgaaggtcacaatggatgacaacgaagggtttctaaacctggatgcataggctaaactggtctgttcgtgacatggtgttgcccagttattgaggcaaatgcaatcacattttaccatttataaaacactttcatatctacagtcttccctgaaagtgcttcttgctcttttatccacctggaaaactcctattcaccctttaagagccctcttagatgtagccttccctgatggcactctcctctccatcattatacagttgtttgctccatcctctgtgctgtcacaatagtatcctcctccttctggtctgtgaagttgccaggcaaaggagattgctctgctggtccttgtatcccaggaactcaccattgctcctggcgttggaaatacatgcaggaacatggctggtttactagacagtttacccaaatttttaccatgactctgtacgccattaaaaaaagagagatttagaaagatttactcacctgcctcaagtctcacagctgccaattaactctttgttgtagagagctgtctggtggttggtggaatttagcagtctcaggacacttggcttcccttttgttttccagtaaaatttgagtcttctgggcactgattttagattggtacaagagacagtgattggatgcagttttagctgttctaaagaactgagtgatataactttgtggcccagggcttactttattatgtcagaaagacgtgagtttgaatcccagcccctccacttactagctgtgtggctttaggtgagttacttaacctttctgtgtctcagtttcttcatttctaaaattggaatcacaataatgcctatctaatgagattatttttaaggattacatgaaatagcatatttaagtggttttagcatttttgccggttatgtagtacacactgaataattcctagtttttaatactgtttttatttctatttctcaaacagtatattctgttttatgttgatgtattggatccttccttctttcctttggtaaactttgttgcatgtcttctttgccatgtattgatgtcagaaagaatccttaaaatgacaatacccaattgcatgattaataccacttcttgagtgcttggttcatttgagcccaacatccattgatcaaaatcaataatcaatgacaggcattatttcatttaatcttcatcacaacgttattaggtagacctcatttcttcccattatatggaggagaatactgagactcagagtaattagctgagggtttaagggaagaatggattgaagctgggtgtgctcagacacctgcggagggagcagaggagtccagcagtgtgttgagccttggtcctgtcctggccctgtggtctgtaagaaggaagaaagccacctccatgggtgccagtagctgctttcttgacactttttttgctgctgaaggaaaagtaccagatactctccccagctgactctccagggtcagtggagattcttgagggtcagtggaccaaaacggacctccagggtcagggtcattattgagggtccgtggaccaaggtcaagaggccttgggagttgttctgcagggtgtggcatggttcctgcccaccagttcccttctgggaaaggagagggcaattctgaggaacaaagaagttcagaagccaccagagggagcagaatcctgttctgcctccttgatctaccagagaactgatcactaattaacaaagcccagcatcagattctcttcacgctgccaaagcacaagcaaaaacttaaaaattccctctgtcatccacatgggactgtccaatacataaataaggcagagactcgttttgagtgtctgcgatgtgcaccttcctgacccaattccatgaattctctcaataacgctaaaaggtgggaaatagtcatgtccccactgcacagattcaacagtatattcattcatgcatcaagcatgttttcagtgattctatgtgccagacatgtgctgggcactggaatacaaaggtgaacaagacagctggggcttggggcttagagaggtgaggtcacttgccaagtcacagagctaagtaagcagtggagctgggatgtgtccatcccctgcagagtctgagcgcccacctgttatgcagaagtagtagtctggctgagatccctgggctttcttcacctcagtttccacatgcagataccagcagtaagtcatatgtggtatgcttgccttcagcacacatttcctcagtggccacctgggcacagaccctacccagaaggagtttatgctctagcaaaagaggcgggcatgtacagagttggtcagccatgtgccaaggcagattgtgataaaatcaagagctgagaatagagtattaactctcactggggtacatgtctttagaggccaagtgacaagcctgaggcttctggtgaggtttgggcaggctgatgacctgaattcagcttttctagcgcgggtggaggtatttctgtttcttggttttgcaaatacgaaaagaccactgggtgtctataatttccacttgtttcaagagaggtcactgcatacctgattttaaaaatgccttctgagtttctgccagtgcgagtgaatgctcagctggtaaacagccccaatgctggatgagggcatagagtcccctgggtcctgctgtgcaggccatggtcaggattacaaacagaagcccttcattaccaggcatatcttagcttgtcctgtatagtcttctttctctggtgagtcacttaaactagcacttttcatacttcactgtgcataaatcacctgggatcttgttaaaatgcagattctgatccagtcagtttgggacggagcctgctaacaagctctcaagtgatatgatgccgattgttcatggaccacactttgcgttgcaaggatgtaggccagtatctccaaactggtttacatagaactttagtgttcagtaaggtgtttgttttgccatgttaaataagtttgggaaatattaggttaaacaaagttaaatgagcttttgcactgcaggacttctcagaacttttaacatgttactgtgcacctgtctctccaagacttggattgagtatacagtttcccagattttaccaggaaaacccccattcttgcccaagtccctcccaagagtagccatttagttgtgtgttttggaacacagctcagacatcactgctctggactttctcattctggaagctttttgctctccacgccaatgtattttcttccatgcttcatcttcctccagtctctgcatatgtttcctttcttagcctggagataattcattaaagcagctctcccactccctgcctccctcttcagatacacctttccacctcctaacaccgtgactaaaaaacaccatcaatatttcataaactcacagtgacaaatttattttaatgtggtccaccgagagccagagattgattggtccctcagaagcgtgacacgtttcaaagcaggatattcatggtgtgttttagtgcctacattagtcagagaggagcggagcccggatttatcatcgttatgactttcttggtatctattctcttctagccactggcagcaactctctgaatgctccctattgattggttttgtgtctttaaaatgtgctggctggggaggagaggggggacttgggtctctatgaaattgagcctagcttgctggagtttctgcatattgggagcttgtgtttgggtgaagccaactctaattctcttggttttcactcatgagggcattggaaaaaggggctaatctccttgatttctggagagtattagtgattggaaaatgggacaaatgtgtacggggactgttttgccagctgtcactttgcaagcctgccccactggctgagcaggtcatagtaagtccttgacatccgggtcctgaggcttgacagtctgatgaggttttattttgttgttgttgttgtttcccccctccccctacccccaacctttcaggacaggtacagagtagggtcaaaattgttcttaaatttagaaaatctcttcctctcacagattaaataataatgataatggcaagtgacctttattgagcacttacaatgtgcccagtacagtgggacatgcattacagacataatttcttttcataataatcctaggaggaagaaattattatttccattttacagatgagaaaactgagggttagagagttaagtggctggcccaaagccctgcagctggtatgtggtttagtgaaaactaaagcccaggtcgagccaactttacatgctagctcttaatccataggcctgactgcctaagtgaagcagcccagagaacctgctgttgcctaactgataagctataattaatatgttcttacttattcatccttactgattcagaaggtaaggtctttcttcagcaatactcttgggctaatttgagtttctatctgactttctaagttaaataagctattgctctttttctttttctttttatttatttatttatttttttgagacagagtctcactctgttgcccaggctggagtgaagtggcacgatcttggctcactgcaagctctgcctcccgggttcgcaccattctccctcctcagcctcccgagtagctgggactacaggaacctgccaccatgcctggctaattttgttttcgtatttttagtagagatggagtttcaccgtattagccagagtggtcttggtctcctgacccttgtgatcctcccgccttggcttcccaaagtgttgggattacaggcatgagccactgcgtccggctgctattgctcttttaaattaccccagtttctcattaattgagatctcctcaaattaatatgaactaatgagaccctatcatattgccacatcactaaaagttgcatttagtcatatgtggcatgcttgtcttcagcacacatttcctcagtgcccacctgggcacaagccctacccagacagagtttatgctctagcaaaagagacaggcatgtacacagctggccagccacacaccaaggcagattgggataagactgaggggcactgtgtaattggagagctaaggaaagagcagttaactctcactgggataaatctgggaatatcttattgtgaaatatcaattgtgtggcgcctggaaaagatgaaaaaagatttaaagaagcagagagggttctgaggatgctcctccagggaagtgtcataaacagagatgcagcggaagggggaaacatgttgtgtatgttagggacatatgactcagatgactagaaaatttagacaccctttgagttcatccttccttgtatggataaacatgataacacactttctcccctcatatggataaggatgcattaagcaaaatgactgtgaaacaaatcctagttccacttggcctccattaggaagtcaaagatatatatctgggagggagaaaaaaaatcctccagcagattgaactgaagcatattgagcagttgaggcagcaagcagttaatcctggtgactgtagacagcagccatctctgtgcagtggggtgcgtgggcctctgcttagcagtcaccttcccactgaatcattttgaaggggttttgccaactctagggtttcccctgaaatgaagaccatccccttgctctagacaacagaatttctttcatacttaggcaacttttgacttcttattttcgggatccagaatttagctgcttctttttgccaggacataacagaaacacattgagagagtcggctcactagggctctgaattcctacgattgtttttcattctttctgtttcggagaagggaatgaagattagggataccagctcctgtcttggagttactgtaaaatccagtcataaccatttctaggagagtttctcggtggtctgcagatgacctgcatcatacacaccaggggtatcatatgagtaaaaattcccagcttaagacctgggtgtggggcccagaaatctgtattaaacaaaaaccaaacaccaacaaactaatcagaggtcttaatggtcagagatgcaatgtgtggttgggtaggtttgccctgtataccactgagggctccatttacataatacataggcagcccctagatttgtgcagtgcaaaacctgtgcaacagctcatggcagctttgcattgcagaatcaccgtggtgagatattctggcattggcatgtatcaagtccaaatgttagcacttttttctgatttattctgcctcaccatctactgggcatgtcagagatccctggggcccagggtagagcagctacagaggccttatacaaacctcattctttaaaggaagaccccaccagagtgttcatctgtagtaaattgtcaggtagattggggaattttggaaagattcttcatcaccaaataaaatgtgtttgcttcttttttgttatttatttatttattgagacaaagtctctctctgttgcccaggctggagtgcagtggcgggatctcagctcactgcaacctccacctcctgggttcaagcgattcgtactgctggacttgatgcttgaattcagcagctcatggaggatttgcaccctattttctgtctgtgaagctgctaataggcccaggattcctcaagaccacgttcggaaatgctgccccatcatcccctgataaagttgacaaagctcagccagaagcaattctgatgcagaggagagtacacaggacgagaagaccagtgtttggatcatgacccatcagttactggctatgatatcttggatacattattaaaactctttggaccttggttttgccatccgtgaaatggggacaagcattctcacctcctgggcagatggagagaatgcagtgtgctaacaaatgaagagtgactatcacagtaaatagtatttccttcctttattcaagcatgtgagggactaaaatgtatcaggcatgtgctaaacatggggaaaataatggcaaatgaattcacagagctgctattgttagatcacagggttgattggaaagactgaaagtgaagaagtcaacacataaatatagtccagagagaaatatgtcccaggcagaaaattagggctgctttaaaatggattatcagggaaagcttctgggaggaggtagcatttgatctgagacctgaatgatgacagtatgtgaagaagacagacaggcaaagagcaggggatgagcatttcagatggagggcacagcttgtgtgaaggccctgaggcaagggctagtatgatgccctggagaaacggaaagactgctgctgtggctggaatacagaatgagagaagactagagaagactgacatggaacggagcatggggatcaggcaaggggtttagttggaagtagttcttagtgtagttggaagtaggttcagaggtaatgctacttttccttttcccttctgtggactcagctgcttgattcatgccttatatcaattaagaatgtttgtagcagccgggagtggtggctcatgcctgtaatcccagcactttgggaggctgaagtgagcagatcatgaggtcaggaaatcgagaccatcctagccaacatggtgaaaccctgtctctactaaaatacgaaaattagccgggcgtggttggttgcagtgagcagaaatcacgccactacactccagcctggcaacagagcaagactccgtctaaaaaaaaaaaaaaaagaaaaatttttttttgtagctacaagtaacaggaaatgtaacaaagttgtcttaaataagcaaggatgtgttcttctcacataacaatatgtctagaggtatgaagatgctggtcctggttcagcagctcaacaatgtcacatctctgggctggcctccctgtgattctcttggcgttgccctcatggtcacaaaatagctgtcatagcttcaatcatcacatccttacaccatggtcaggggcaggaagcaggagccagtgtgggagcagacagtttctcttcaagtgcctctttttcataaggtcagagaaaactttcctttagcagatctctttgagtcatattagagtggaatgatatcctggggtccaagcatctccacctgatgaagaatgggtggagttttactggcaagaaaaaagtgcagggctggtaatcacagtgatctccaaattccccatgttttcacctagctccctgagtgaaggctacagaattttaagttttgcctccaactaggaacagcagccctcagagcaaatttcagtcttcttggaagctcctataagacttcttatttttctctggcaccacacaggccacttgtccctcttgctctttagcaagttgaaggcacaggatttaattaaaagcaaaacttgacataagtgtttttaattgtaatagaaaaaagctgcctgttttataaaggtgacagtttgcaaacacaaatgtgaacatattcctacctcacttggcggcggccccgtcagagagtggcagagtggtacaaggagatggatctggtgtgaatgacttgttcctgcagtgaaggatgcaacctgaattcctcctgaggagtgccagcaacacctgtcatcaggtccacttagctaatgagatccaaggggtagcctctggtaccaccgtttctctccagccttcagacttgcctggaagaaaggtgcagttccctctcatattggagaactgggacatccatgacacactgcagaagccagactgtctttcactcaggcctgagttcagtggtgatgcaaatcgttcattctgtccccaggatgctttccaacattcatgtttttaaaggtcaatctgggccgggcaaggtggctcatgcctgtaatcccggcactttggaaggccgaggcgggcagatcacctgaggtcaggagttcaagaccagactggccaacatggtgaaaccctgtctctacaaaaatacaaaaattagccgggcatgatggcgggcgcctgtaatcccagctacttgggaggctgaggcaggagaatcgcttgaacctgggaggcagaggttgcaatgagacgagattgtgccactgcactctagcctgggcgacagagcgagactccatctcaaaaaaataaaataaaggccaatctgctggctggggagctgtatttgcattcttctcctggatgttgggtcagtgtagattcagctgtggtgtactcatggaggccactgcatcttctgggtagaagactgagtctctttcaatctcgttttgcagagagatgtctggagtgtagaaacctaggaaacattcagctgcagagaatagaaagtgactcagataagtccagacagaaagaggatttactgaagacatctgagtctctcgaaaaaaatcatatgcaggagccatacgtgggcttttcttgcatctctgctgtatctccctttctagagatctgattgctttgcaagcctcccaaattctcagccttgtggacttctttctcagttttctgtgttgattctagcctagcctccatctgaccttgctattcaactgctcgttcatttattaattcaatgattcattaatttatcaaataatcacagaattatgtgtataatcacaaatggagacacctcctgcaaaggaaaggattatggtgttctacagccaaatgcttcagtttttgtgtctcagttcccaccattctgggtggagaatatgattggcccagcctgcaacacctggtccaatcagcaatggccaaggggtgatgaggtcgcacagggccaggcctgtgaatggagcatattgtctaagcctgggtatggggtgggaggaaacgcttgaaatctcttttacaggaagagcttcagatgagatatccacagagttaccttggatggaatctgatccacttcaggcttagttctcagaaaagcatcactaattatacggacgaacaggctcaggggtttgcattctagatgtttggtttgattctgactggctgcaaatgaccagcctaactcactggatggagcattctgcgttccaagtgccaggtgtgggcaggtgtccagctgcagatgggcctctgctgacatccaggccacaggctgagtggctgtactgaagggaacaccaagcctttgattccataaggtccctccttcactgaaatgagatgatggcacaggtacctcaggatggaaggcagtaataagcactgaaacccagctgtacagctttcccaacatttcatgctaaagctttgagtataaactgagcagcatgacgagaacaggtgtgaaggaatctttcatctgctcattcaccaggctttgatggaggatggaccatggctgacccagtcccaggcatggagagtcttgaggagttcatgatgacagccttccccatcccacagtgtttccctccttgaaggagttaagtaatggtgtgaggcagccccagagtctaggcccacagcagtggagtcacgtgctccttgcattccaggactggctgcctgaggctgggacttgcaggaaggctgtatacagagagctcagggcaatcattcagggttctgagggtcatgggaggcctggccaggggtggggggtccatcgctagcagcccacgcctgactcttcactttactccacccacttctgttctctgcagccaaggagaggcggacttccttgttctgcctggttttccccacgtgctaccagctaataggctgcagctgtatttcagaagagttgccacaaggaaaacttagcctgtaagtcaagcactttagttctccaggcgtgaaaaacaacactctttatttctggccatgcctggctttgtgagctgtgtctaatggcctcataaggagatataccaccgcactgtcagagtggtcctgggatttctgttagcaggtgaccctctgtccacaggtatggaaagggctggagttggagtcttggcctgtgatatgtttgccttgaaataaatgtcttaaaaaatctgttcaacattaaacaaaacaaaaggaaaaacaggaaacaaaaacaaaaccaaaaatcattactggatttttgggagcatgaaaagaaactgcgtgaaaagaaacttcgtgaaaagaatttacacagtgcttggcccctattgagggctcaatcaatattagttgttattcctattgtaattacattaattttgctaaacatttcaggcacaatgtcactgttcttcccagcccatgtcagtctaaatctctattgctggcatttgccctggtctgttttgttgttgtctcatgtagtagcccaggaatcctctgggattggagacccccatctgtacccgcctccttgtccgtatttggggcttgcttccacaggcagaatctgggatctgtaccaccatagagaagctttgaatatcaccaaaggtaaagtcttgcctggctggtgctcagctgcctggttagcctcagctgaagttctaactcttctaggaagcatccccgaaaagtatcctcctttctgcttcaatccacttttaaaaagcccctgtgtatggaatattgtatttgccaaagtgggcagcaataatatttcccattccatatgcttttttacaatgtgactttgtcactttttccagtgagtggtagtgtcatctcttcttgagtcttagtgaatctttggctaacagactagtgtagattgatgctgtgtggcttcggaggctgtgccattgaaatgccacgcagcttccaccttgctctcttgggatgcttactctgggaaccagccaccatactgagagtgagcccaaattaactcatcttgagagaccacatggagaagtaacgtgcactgttccagctgactgtccagctggggtccaaactgacagtcagcatcaactgccaatcatgtgaatgcagtacttccataccagggtcagcaaacatttttgtaaatggctggatagcaaatatttttggctttgcaggccgtacagtttctcttgcaactatttgactctgctgtcatagggcaaaaatagctatagacaatatataaacagatgggcatggctggattcggctcacaaactgtagtttgcatcccatgctctaaatgactccaaacccagccattgagtcactgtcatcctcccagccttccctgttgagcttctgcctgaatttctcatggacagatgccatgagttgctttctgctgtgacgttttgaggtggtttgaatgtagcaatagcacctggatccctccatatctctgttttatgattatcagttttatgattcctatgcctatccttctagttctgagcttcccaaaggtaggtactggctcttcctcctctgcctcctcttcagcagatctagtactagagtggcaggtgtcatgtcatgcactttacatggattgccatctttagtcttcccaactattattacatctctattttacaaataaacacagtgaatctctgggaggtcagtgaattgccccaagtgactcagaaacacacactcctcaattccagggcccaggattttatccacgataccatctagcctcaatgttcatggcataaaataaaggtgtgggagcctgagaaacacccacccactcgattgaaaacaaaatctgagtccagaggccacacatgttcaatcccagctccactctccatgccttgcagagttcctgggcacaggggattggtatagtttggatgtttgtcccctccaaatttcatgttgagatgtaatcctcagtgtaagaggtgaggtctggtggggggtgtttgggtcatgcaggcagatccctcatggcttagtgctgttcctgcaaactgatctggttgtttaaagtgtgtggcacatccccttgatctctgttgcccctgttttcaccaagtgagtcacctgcccctcttctgtcttctgtcataagtaaaagctccctgaggcctcaccagaagccaagtaaatgctggtgccatgcttcctgtgcagcctgcagaaccgtgagccaattaaaccacttttcttcataaattactctgtatcaagtgtcagatttttctttacagcaatgcaagaatgacaacacagggttgtacagtaaattttggttgggtgagcaaataagtgagtgactagtgcacatcacattaggttccccatttggttaatgtcagggtcaggtggactaatgttggagcacattcccgggtagaccatttacttcagtgaataagccttgtgcagatatggttggcagcctgtctgtatcccctctgcctactccagcaggtgcctgcagacagttccataaatgccagtggctgtttccctctgcctcagtgcatgcatagcccaagggagtggctcagcttgcaagtagaactggtcagaagggtgggataacaatcccaggatcagccatcaaccaatgagggatgggagttggtgggtaagtacccccgcttttcacccttccaaagcacaactctgaggtgtgctcacaggagtctcacagaggagccctttgggatggaggtgcattgctctttaacctcttaacaagttacctttcttctgttctcatctcaatttccaaaccctcacactactttctgaaagcacctcccaaagaaataacttgtagccaaatcttagtcttcagatttgtttaaaagcaaacctaaagggtttccctaagctagaacagatgtgtattgtacatggtgtaaaacctggtgcacattctagtacacatgtgtacacgacacatctgcatcaaagtctgagttaggccgggcgcggtggctcacgcctgtaatcccagcactttgggaggccaaggtgggtggatcacgaggtcaggagattgagaccatcctggcgaacactgtgaaaccctgtctctactaaaaatacaaaaaaattagctaggcatggtggtgggcgcctgtagtcccagctacttgggaggctgaggcaggagaatggcatgaatctggggggcagagcttgcagtgagcagagatagtgccactgcactccagcctgggcaacagagcgagactccatctcaaaaaaaaaaaaaaaaaaattctaagttagtgcaaagacataattattggttatattttcacggatgtggttttcttgcctttgagtatatatagtaactggaattaggctaagatttgtttattattctaatcaatagatacgaatgatttgtaatcaaatcaattgcatttaagtaattggtgctcagaaatacttgagggagattcagaatggtgctgtcttgggtggttttaatcatcttacccctgaatcttgctgtcaccataactttctatcaaacctcttcttcatgaatcgaagatgtgctggagtccaggcccagcctagctctgtcgcctccacactggccaaggtgtaggagggacacatttcagattatttggagttagtgggggcatctggactagcatatggggactccaagtgttgtcctgggaattctattggaaaattatttttggacactctttgtagcttaagctgtgtgtgcatccctccagagaattactgacaggtgtctgggggcactaccaatgtgggtcactgagcactaaaagtgtgtttattttggaccactgggagatttactttgagctgcatattcactggagggctggcttttggttactacttttctaggacgtcccccccacttctgatgtgctgagcgctgagcaactgttaattcagatcttctggggatggtggggggttggcggaagagtttacttcacagcttcatatagagcatagacctttggggtcttggtgagattgaggagggtcttctaataaactctcaagcttgagttgacttcgacgttgtcttctctttcccacattctatgaggttgtgaacattgaagctcaaattgtccagatttggcaaatactgtctggacaaaagtctcttcggcattccatatctctctggggttcagcctttacttctactttgtactgataactcctttcagctctttcatgattttaggaagatttacaaaatacatttgacccattttttaaaaagttactttcatcagggaggctaattccaatacctaatccaccatattacaggagacaagtttctgtcccaaggatttaacaaggagcctctctcagttgaacactgagcaggaaccatgagttggagaggattctggagtgtgaggacaggacttttaaaaaccttagctcaccattgcagctttggacattagtctgctggtggccccatttatatagatcaaccagtcagggaattaaatactcttgtcttatgaaccaatgggaactggaacaagtttgatctgtcttattacagagggctgaagtcctgatttggtaaaagtattctgtgattgggaacctagttatacccaactcatccatccatccatccatccacccacccacccacgcacccacccaataaatagggacatagtggaatcccattctgagagaaactcagagaggaaggtgaaaacagacagcacacatgttttaacaagccttccctgaaggatttaaggtattcatatgccccatttgcaaactccttcctgagccaagtgttggatccaacaccctgtcatcatgaacaaattcctgataaaatacatcttgtataaaaatgagaatgagagacaagtctttgtgagaagagtagatagatgtttaaattaagattaagattttttgactggtagttaccaccccagtctttagtctaattctggccactgctaattttataggattacaatgggaaaagacactttcttcccctcttgtgtttcatattgttttccactgaagaaagggaaatattagaaaaatgcctttcaggaacgaggtcctatattagagcaataaaagctaaaaccctagatctcaatggtgcaatgcaaaaaacgttcattttccatttattccaagtccagtgattgtgctcctgttctgtggctttcctgaaaagctttccttcacgtgtgactcagggactaaagatattgctattttgggatgctaccacattaactctgtcaaccaacttaaactaattgacatctataaaacaacaacagcagaaatcacactctttccgagtgcacatggagcatttaccaagataggccatattctgggccataaaacaaacctattagttttgataaatttgaaaggattcaagtcataaatagaattttctctgactacaattaaattagaaatcaataagaaaaaagatacctgaaaaatcctcaaatatttggaaatgaaataccacacttctaaattagccatgggtaaaagcaggaagtaaaacatttttaacaaaaaaaaatatggaatttatgtgataaagctaaagcaatacttagagggaaattgatagtgttacatgcctatgttgcaaaacaagaaaacgttcacatcaatgacttcagtttccaccttaaaaattagaaaagaaggatcaaatttaacccaaagtaaacagataaaagcgaataataaaattcagagtgaaggccaggcatggtgactcacgcctgtaatcccagcactttgggaggccgaggcaggaagataacctgaggtcaggagttcgagaccagcctggacaacatggtgaaaccccgtctctactaaaaatacaaaaattagccaggcatgtggcaggcatctgtaatcccagctactcgggagactgaggcaggagaattgcttgaacctgggaggtggaggttgcagggagccaaggtcgtgccattgcattccagcgtaggtgacagagtgagactctgtctcaaaaaaagaaaaaaattcagagtgaaatcaatgaaatagaaaaccaaaaaaagagaaaaatcaatgaaatctgaatagacctatgtctgttaaagaaattgaatttgcaattaaaaactttcccataaagaaaacttcaggcccatggtatcactggtaaattttatcaaacatttaaggaagacataataccaaacatacacaaactcttacagaacatgaaagagacttgactatttcccacaagatgtctgctctcatcacttctattcaacgttgtactgggtgttctggccggttaaactaagcaagaaggaataaaaggcatctggattgagaaggaggaagtaaaactatctttactcacagatgacaagattgtctctatagagaatcccatggagactacaaaactattagaactaacaagtgagtttagtaaggttgcaagagacaagattcatgtatgaaaatcaattatttctatatattagtaatgaataattgcatattggaattaaaaagcaataccatatactagagaataatatgataaaatgtttatggataaatctaataaaagacatgaacaatctataccctggaaactacgaaatatcactgagcaaaataaaagacaacctaaatagagtgctatgtcttgctcatgggtctgaatcagtattaagaagtcatttctctccaaaatggcatatgaatttaatataattccaagcaaatggacacactaattctaaaattcatttggaaatgctaagaacctggcatattcaaaataactgtgaaaagaagaaaaaagcttgaagtcttatgctacctgatttcaagatttgttgtaaagttacattaatcaaactgtaagttttgtcatcaaaatagacaaatagatgaaggtaacagaattagagagtccagaaatatataacagaatagaattccgcatatataggggcagctgattttcaataaagtgcaaaagacaattcaatgaggacagggtagccttttaaacaaatagtgcttgaagcatttggatatccatatgcaaaaatatctaaactttgatctgtaccttctaccatatataaaaatttaaaaaaatggatcatggatccaaatataaaacataaactataaactatgaatatatacatataagtataaatccaaatataaaacataaacctataaaacttctagaagagacaggagagaatctttgtgactttggattaggcaaagagttcttagataagacaacaaaagcataagtcaaagaagacatggaccaactgcctttcatcaacattaaaaacatttggtcttcaaaagatactgtcaagagagaacacaaagataagccacaggctgagaggaaagctttgtagaacaaatatccgctaaaggacttatatccagtatatttaaggagctcttaaaattttatattaagaatacaaagaccccccaaaaattgaacagaatatgtaaacagagactttatcaaaaaagataaatagatggtgaataggtacatgaaaagatgttcaacatcatgagccattagggaagtggaaattacagccataaagtgagatcactatacaccaattaaaatgttgaaaattaaaaagactgatcacaccaagtgttggtgaggatgtgatggaaaaaaaactcatatattgcagatgttaatgaaaatggtacaatcactttaaaaacagtttggcagtttcttaaagtgtcaagcatatatctactatataacttagctattccattcctagatatttgactaagaaaaaaggaaaacatatgtctacacaaagacttgtacacaaatgttcatagtagccttattcacagtagcctcaaattggaaatagtccaaatgtttgactacaggtgaatggataaattatgactctagtcataaaatgaaatactactcaacaataaaatgtaatgaattattgatacaggtaacatggataaatcttaaaataatcatactgggtgaaagaagtcagacaaaacagaatacctactgtataagttcatttatataaaactttagaaaatgcaaactaatctatagtgacaggaagcaaatcagtgattgtctaggatggggagggagagaaaggaggattataaaaggccataggaaaattgttgggatgatggatatgttcactatcttggttgtggtaatggtttcatgagtatacacataccaaattgcatactttaaatatgtgtggttgactgtatatgagttataccctaataaaggtgttaaaaataggctatctggctgcttggttgaaacagtttgtagatgacaaacatcaaagagaaggcctcttttggaagtccactgcaattagttcaggtgagagatgattggagcttgagctggggtgatagtagggaaggtggtgagtgaaggtgggattccagatatgttggagatgggctgtgagaggaaaaggtattgaggcttgggatgcagtttcctggcatggggatggctctgggagattaaataactttccctagtcatgctgcgaactagaggctattctgggattgaaatccagatctgccaagctccatggaagtcctgaagagcaagggctccctcccttctcactgtttgtgaaccctagggtgaggagagatggagtgtgggtacaggacctggctgagaaatatctggatgtggaaggttcctgcttgcctgaaatgcagggccctgtggtcctgatttaccccaagcttcctcagttcctgggggaaggtaagatgggccaaggtaggagagaagaaggacaaactggatgaaccaagtaggtgcctagaactcaaggcaaccttgacactgaagtgagggtcctaagagtgcagttccttaacaacttcaaaccctgctgaactcaccagaccctgagccttgagagtgtgactgagcacatggagggctgtgggtgtggtacataggagtggctgtattatgtagggtgaccaattcatcccagtgtgccagaactgcccaggttttggcactgaaagcttattccagggaaaatgtggacggttggtcatcctacctgtgtgcctgaatgaatgggcatggatgtgtgtgtgtgtgtgtgtgtgtgtgtgtgtggtgtgcatctgtgagttcttgggcctgtgcaagtgggtagagctaagtacatgaaggaggacgtgttaaggagtgtgtatccacgtgtaagggtgttactgggacttcgtagatgtctcaggcagatttatttatcccctctcctgactccttctgtgcttccagaaagaattagaggtggctctatgtgcaaaggcagtgttctgagtggtggagagtgtggactctggagtttgaatggacctggcttcacatcctgcctcaaccactactgcctctgtgaccttgagcaagcaacctaaccactttgtgggtcattttcctcagtgaacaatggacacaaggaccctttatcatggccacaaaagaaataatacatctagaaggatggccactcagtaatcgttcagttcattgtagtgattactgtcactgttcttgtgagtctggtgtgtgagactgagtgttgtcttatggagtgtgtgactgtgagtgtgtgcctgtgtgcatgtgcatgagtgtgcatgtgtgagtgcgtgcaattttgtgtgtgtatgtgtgcatacttgtgtgaatgtacgtgcatgtatggcagtacccatgcaggtgtatgtgagtgcatgcatgcacatgtgtgagtgtgtgtgtttctgctcatacagagccatccactctcagggtgagcaagctaccttgggcttggtcaggaagattgtgtggggtgggtagagaccagggtccctggagacgaggtgtctggaatctctgcgttctttttcatggtgccctcagctcccagcagggctctggccccagttctcagtgatgtgcgttggataggattgagttctgtattgtacaaactgccttattaaaatatatgttgtgcattcatgaatctttaatatgaggcacttagtgagtccataatctcctcaattgagctgtataaaggaggactgtgggggagatgaagactttctgcagaggctgcagtgaggaggggcagctgggggtggggacagaaggttctcacatatgagggtgggggacgaagggacagaaggttctagcatataaggggaggaggaggatgaggatgaaggagtgattcccccagaggaaggacagcagatcccacaaacagaggatggtggttcttgtggactgaaggaggcagtttccatacactgaggacagcttttctcccagatggaaggagaaaataggtggttcccatggactgagggaggatgaaggaagaaagtggttcccagagaccaagggaggtggtttctacagatggatggaggagagaggcacttctcatagacaaggcaggtggttctcacagcctgagggaagagggaggaaggaggtggttcccagaggcagaaggagtagggaggcagttttcacagagggaggagggagaaagaaaatggttccaagataccaagggaggtggttccttcagatgcaggaaggaagttctcacagatagaaggaagtggttcttacagacatagggaggcagttcccacaggatgtggggagtgggtggttaagatccaccaaggctgcagggtctgatctaggtattactcttgcaaagaggttgactatgtaaagggagaggacctatgtattttatggccatctggtcaggctggcaggaggaggtcagattgccctgggaggcttggtgcattatgggactagagtgacttttcttggagccaaaggcctgtccgtggcttcttttactcaagctgtacactgtctctgcttactggcctgcttgcatgctgcaggccctgctcagagaacctgccccactgccttgtctgcttagctgtagccattggaccaaggggcatctgctgatctgttgtcagacatctctcattgctgtgagatgcccatgcatagctcagaacttggcatacagactgttcattaaatatttgttggatgtgtgctggagtccccactgtacctagaagaaatggaagtgtggaaagattaagaaatttgcacaaagtcacttggctgttgtcagataaggagatcaatcacattctctcttaagaatataatttggagacataaaataggagttggtagacggcatttgagctaaaagttcatgcacagttggggctggagttggtgtcttgacaacctaatttatttgaattattgggtgacaggtgggggtgagtaggcaaaaaacgtacaatgaaagaaacccctctgaagaggagataaagctgactgcagagaaaagtggagatcaaaagacagagacagatgtagagaaagaggagaaaggtgcactcttccttccttcctgaatgggagcaggtttgaatgagttcaagaccctcccagggctgagcttctggcctgaatgccttgggcactcagtctttgctgaggcaggtacaggacagacattttctcactggattttcaccgtcgtcttgtactgtgtgtttcccattttatggttgggaaaactgaagctctgattggtgacaaatgcccaggggcacacaactgggaggacacagaggccagattgaaaactactcttttctagctcactgctctctagccacactggcctgggacaacccccagtcctgtctcggggtctttgcactttctgtccctctgcctgaaacactttatccttatgtccacgtaactggctctttctgaaccttgaggtctcagcttggtgttgcctgcttgagaaagttcccctggtcaccctgtctaaagcagccactacaagcttttattcagtaatagccctttggggttgctgttgctgttgtttattagttttggtctacacggcatttatcacaattggtaattattttattgattcaatgatttaacgattcacacacatcctgtaagctccatggagagaggcatggcctgtgtttttgctgtgagatgcccatgcatagctctgaacttgggcatacatattatgttcattaaaaatttgttggagtctccattttacctagaaggaacggaagtgtggaaggattaagaaatttgcccaaagtcactgagaaaacgaatagctggagcaggggttgaaccagcatctgatccagctccagagtccacactcttcttcgactgtcacactaggaaatttccatgtactcctcctttgtgaaaatcaccgtttctctgggctggaagatgtggcagaaaaggctgtctcccactggtctgggcagtgagcacactccacacccctgctgtttaccccctgtcctgagctgcagtggtcaggacgtcaaggttcaagactcagccctgtgctagcttgctgtgggaacttaggtgatcaattacctgtgcgtgtctcgtctcctgccagccatgtggctgaggccctgctgtgccctgtgctgaataaagacacagagagagagtcaggagtgtccaggagcagggtgggtgttgaagtgcctgctcagcttctgccatatttcattgtcatagctatcaaccttccttaatttcaaaggtgagtttgagcacctgggagtgaggggagagggatgccaagggtcaaaggcgaagcatggcagaagacaggtcactgctgccacaggcactcaatgtctctccctctgggagtgggctagggggatgtttatactcttgaaagcaagaaactaggcactggaggggctttaggaggtgaggagtggaaagagtctgctgccctggttcactgaggtggaagccaatagaagaggagggcacttggtgcctgggcatggaggggaactctgactatcctgtccctgctcccaagaccaagaagagcactggggccactcctgggcgctgactccctgcactctggctcagctatgtggaggaggcccctgggagaggggcctgggggggccaccaaagaggaggtggacgaaaagccatcctgctgtgtctccctgaagcagcacgagcacacgcaattataagacagtgggcagatgacagagttagttaatgtaacaagccctttaagcatttagccacattcgagtgtttaatcagctgtgtaaagtgcaatatctatctttcaattttatgccattaggggagacaagattttgattaggtacttaatctgtgcacggaaaaaacaggcccacagcaagcccacgatggggagggaaagggacattggacgggggattcgataaaggggaaagacagaaatttaacataaaagagaattagtgcagctcctttcaatttagtgcccaggctttatggcctaatcaattagaggcctggccaagcctgctgggaagctgctcggctgggctggaggctcggccatattaattcctttcattacgcgggggtcaggctgagggctttgggggggctcggcaaggagtgggtcacttctcgggcactggctctagaagccaggggaggaggtcaaatggtgtcatgctggacaggaagtgtcctgggggctcaaggagggctgggtacccagtagggtgggactgagagggttctgggggggtgcaggcccatgaggtggtgtaaagtggtgggtgagccctttagttgtggagtaggagaggcctgggtttgcagaccagctttgtgacctattggctgtgtgatcttggacaaattacttggcctctctgtgctgcagttttctgtagaactacaactgtggctactccaaagggttgccatgaagagaaaaagaaagtagcatgcaaagagcttacttagcatagtatgtggctgagtgagcactcactcaatgttagctattattgttatttgtttctaatactattatatgtgccactggaggtaacattttaacaggcaggagctttaactgccaccaccaccacttcctttacacaccagtcattgtgctagatgctctttctattactaacagtagttttacaggttggtgctattgcctgcagtttacaaatggggaaagtgaggttaaacaacttgtccaatgtcacacagtgttggaggccccagaattaacactttctctcatggtccttcctatcacagggtgctcactccttgctctcatggcagagttaaatgggactgaattccttaatggtagaggtcaccaggaaagggtagccttcctaaatgttcccaagggctctagatcttaacaagtcaccttccagttactgagtgaattgtagaaaagatgcctgaggctgggccagtgacctttacagaatcatggagaccttaaaccctgggaaacgaaagttggtatcctgaaagttttcttaagccatggcccatgaaagacagaaaaagtagggctgcttggggtggaatggaaatgaacagctgggtcgccttcaccacctcctctgtggctctagcatgtcctgagaggcacctgggcaggacctcagggtccagagagcccactgtgaaacccctagagctgtgagtgagttggatgcagagttcaggtggtaaagctctagagggactgttaaagaaaagccgggaaggaagtggagaccgttggaaccagcaaatgtgtcagttgaaggggcttttcttctttagcagatatgggaagggggtgagggagcatgctaagatttattgggcacctgttggctgacttctcgctcagtagctgtgagacttagggcaaatcattcactttctcttgccagtttcttcagttgtaacctggagtgatcatggttccttcctcacaggctggttgtgaggaggggataagctgatgtatgtcaagtgccgagaaccctatgtggcactgagctgagtagggatttgaataaatattaattattgctattaccggctgttacctcagcactttctaagtgacaggcccagtgctaggaactgtatatgtgataccatcccatgccattcctgtgccacctgtgtgggttgttgatatggtgtcagttacagcgatgaaaagtttaagttcagagagatgaagtgacctgtctgatatcacacagctggtgtgcaatggggaggagaccatctccttgaccgctagttgcttctaaaggccttcttccatgaagtgccacctcgacaggcatatggtatggccagagtgaatctaaactccagcaggacatttgggaaattatgtaatctgttcaacatgtatttgttgaacacctactatgtgccacataccataagccctgtgaaggtaggactcacatctgtcattgccactgccaccgaggaaccacttcacatgtttgtataatgaatgaatgggtgagtgaatggatgttatactgagccacatcctcagtatccttgaggagagggtggagagacgtgaatgacttgattttggtattaggtggagtgggaggcaacatgatagagtggacagaaaaatgagaatctctggattggaatcctggacttctctctctgcagttagatgagatgtgtaacctctctgagccactttcttgtgtttggcaggggcaggacaaaagtcctgctcttcttgccttttcccctggctgagatgatcaagggaaatttcttggctcaaggtctggcgcatgatagaggctcaatgaatgttacttgctatccatcctgcttttttttttttcttgaatgatcaataaatcagtgaacccatagttggtatcagccacgagggaatcttttattgaggtgtcattagggtttgtccttgatctctccctgttgacattttcagaaatatgtcaaataagcatgaaacaacagtccaattactgctcccagggcatcctgttcttcatagtatgatccttggttttaaatcctgtgctgcttttgtctattagactagatttccactagggtagggaattaatcttgctcattggagcagactagctgctcagaacactttttttttttttatttgagactttgagtcttgctctatcgcccaggttggagtgcagtggcgtgatctcagctcactgcaacgttcgcctcccgggttcaagcgattctcatgcctcagcctcccgagtagctgggattataggcacacaccaccacgcccagctaatttttatatttttagtagagatggggtttcaccatgttgtccaggctggtctcgaactcctgacctcgtgatccactcgccttggactcccaaagtgctgggattacaggtgtgagccactgcacctggcctcagaacatgtttttgccaaaggactaaataaatggatggatgagagacagagatggccttgcagtaccgttgttgatgggacatagatgggcaggatagtttattgtgcagtagcaccaaacataagaagctttcttgaggtgatagcactgggctgagttttacagaataaaattggacggacaaaactgtcagcctctgcacacggatcctgtaaaccagctgtataaacataagcgtgggtgagagcgaccacttaaccttgtccttcttgattccttagtcgtttggagcagaggttggcaatgttttctacaaatggccagacagtaaatattttaggctttgaggaccctgcagtctctgttgccgctattcaagtcttgttgtaaaagcagccttagacagtatctaagcaaaggagtgtagctgtgtgccagtaaaactttatttacaaaagcaggcagccagcagatttggcccgtgggtgggtggttgccaattcctgatttaaaatacagccccagggagtaatcttacagccatacagcttcacatccaccttaattaacattgactctgggcagctgtgctcccatttcacagaggagaacactgaggcggataggcaaagagtctgttgcagagctggactcagcagggctgttgctccagacatggcaaaaaatatcagctgccacggaacacattatacgtcacgcacttaacatgcatcatccacagagcatcctcattgacctggagaggtctatcctcttattctcctttttacggttgaataaacctgggctcaaggaggttaaatgactgacttatggtcccacagcaaatgatttagcatttatttaagaagatttattgagcatccactctcttccagatgcttttgtacagttggggctaagggaaacccctgacctcaacgtgcttacattgtacttgaggagagtggacaatgaatgaatgaaatgaatcaacaatatagaacgttagaagggaataagggcctgtcagtcaggacaggcatggcttaaagcaagagtcggcaaactctgacccgtgggtcaaatcctgcccactgcctgtttctgtaaatcaagttttagtggaacacagccatgcccatatgcttctgtgcctattttcatgctatgggagagttaagttgctgcagcaggaattgtgtggctctcaaagccagaaattttgtgacctctggtttcaaccagggtttatttcttgttgatgctttatgcccctctgggtgggcccaagagcacagcctattggtccctcagggaaccaggccagtggggcacccactaccttgaatatttgcaaggcaaagcaagattctggaaagagtctcatatgggcaattaggtgcctggcctagaagtgacatgtgccatttctgctcagaattttttggctttacccaacagaaagagttctaactttgccatgggtttagaaggtgaagagctagaaatatttggtgagttgccctgatgaccacatgtgctatgagaaataagtaaccagggtaagctgacaggaagtgccaggggcttttcaattttaagcaatgcctccagggagggcgtggatgagaagtcagctgggatttgagcccaggtctacccatcttgaaagagtgtcctctcaccctccatgctatgctactgtaccctccatagcccataaagaacggttgctgggaaggtcatttgctggccagatggggaagcacactccccttgtgaactcttgccaaaggcctcactgcccctgtccccagccgcctcactccagctgtgggatttctgactctcacaggtcacaaccccatagcgatcacaaccaggcactttgctctccagtcctgggagagatgggctgggggaggagggcgagaggccctctctgcgaggctgtgactccacgaggcactacattaacgttattaataaccctctcagcctttattgaaaagatgctctccgtgcctgaatttgccactatggcaacccatttattaaggctgtaagagctggagtcacttcagaccatatttattaccatgatttgctgagggaaggctctgatctgggactggggcaattgggggagagaacgtgtagttgcttagagggaaggtcttggctcaccttgccagtaggtcagcgagggatgcggtttcattctctcccaactagatcaggactcaaattgcaggtggggagcttgggggttgaacacagtggtgattccttctctttttttttttttttctttttgagacggagtctcgctctgtcccctaggctggagtgcaatggcacagtcttggctcactgcaaccttcacctcccaggttcaagcgattctcccacctcagcctcccaagtagctgggattacaggcacacaccatcatgcctggctaatttttgtatttttgtagagacggggtttcaccatgttggccaggctggtcttgaactcctgacctcaggtgacccgccctcctcagcctcccaaagtgctgggattacaatcgtgagccaccacacctggcctgattccttctcttagtgtgcatacaaggacagcaagactcaaaggagccaagtgagtccccaggggcacagagctgtggccaagtgagcagtagtgggggtcctacaaggcgggggctgatttttctacaaaaatataaactagatttctctctctttctctctctctctttctctctcctccctccttcttcttctcgtgatatataataaactgttttagcaccagaaaaaaaaactcacaacatccacagtgatggtaacaccgccaccagctaatgcaatcagtgctgggctaaaggatttctgttaattcccctctttgaattctcaccatagtcctctgtgggttttatcgttgacctcattttacagaggaggaccctgagttctggggagattaggtatcttgtctaaagtcatacagcaagtaagtgcagagctgggactcaaagccagttctgattccaaagcatgttctcgtatcctgcataccacatcatctccttttttgttgttgttgttgttcttgtccccttttcagattccagaggagtgacaggctcatgtgcatggacaccttctccaataaccgttcctttgtctctctcaggtcccttcctctagaatagtctcaatatgagcacttggtcaatggagtgggatttgcattagtttgctcaggctgttgtaaaaaagttgcacaaacagagtgactttaacaacagacatttattttctcacaattctggaggctacaagtctgagttaaaggtgttggcagggttggtttcttctaaggcctctcccattggtttgcggatggctgtctcttcactgtgtcttcacatggtcttccttctgtgtatgtctatgccctattttcctcttcttataagaaaaccgatcatattgaaccaggcccccccaccccagtgactttatttaagtttatatatattttcttttttgagacagggtctggctctgtcatccaggctggaatgcagtggcatgatctcagctccctgcaacctctggctcccaggctaaagccatcctcccacctcagtctcctgagtagctgccagcatgcccagctaattatttttgtatttttttgtagagatggggtttcaccatgttgcccaggccccaggctggtctcgaactcctgagcacaagccatctgcctgccttggtctctcaaagtgctgggatcacaggtgtgagccaccatgcccagcctcaattttaattacctgtgtaaaggccctatttcagaatacagtaacattctgcagtattgggcactggggacttcaacgtatgaattttgggggaatggaattcatcccatgcaggattcaagaccaacttcccggcatctgaagctctctggggtcagaagagaacatccatggagttctgcagtggagcactggaggcaactggctcctgtctacactgaaagctctcattccccaggcctcactggagcgcaggtcacattgattccatctcgaaatggtcctctcaaaagggcaggaactgtctataattcccaaagtcttctcttccattctaggccctgggcacacagttgccccacagctgttccttccttcacatacttttcgccgttgcccatttaagatgtgcttctgggtatatctgcaatcttcaggcctaggatgcctcctgtttctcttccctgggtttgtgctttttatttctgctctctttccatgactgactacatccttcctggcctccctccctctttcctttccttcttacctccctttctctctcccttagtcctttctttctaactctcttccttacccccaaaaccattctctatacacgtgtcccatgttagggactgtgctagatgctggggattcaatgaagagcctaaactaaaaatttaaagcaaagatagatgcaaaactggaacctctctaacataggccccattctcatgcaacttcagactaggaaggaaaagggtaacgaaagattactgcaagttaatgcatggaaaattgcacctgcgaaagtggcaaggaaaggcagttgtcatgagaacataaaatagaaagatttcttcttgccagggaggccagcgggtgaggctgagctgagccgagccttggaggaggcatgaggcttaactgggcaaggtgacagatggggcagaggtttcatgcacgaggcaaatgatttaggctgtgcaaggaaaaagctgagcgcgattgaagagacaaaagtaggacagtgtaattggaggaaagagagcaagaagcaatgtatgagatgaggttggcagaggccagatcatgagaagcattaatgatttgttgagaaatccattcatttagcctcagtggaatgtggagccactgatgggtattgagcagggagtgggactaggcaaagagaccaggttggtgagtacaaaagatcatccaggctgttgaaagaaacctgagtggaggtggggaggtctgagcatgtggctgggtggggtgggatatgttaacagatagatatctttcattctatgcacccattggactttttactttttccttagtagaagctgtcgcttgtaagaccagatagcaaagacactaaattattgtcttttttttttaagtttattttgagctaattttatactcatgtcatagttgcaaaagtaatacagaaaattcccattcttccagcttcccctgatagcatcttttataatcacagtataatgatcgaaaccaggaaactgacattggtacaatattattaagtaaactgtagacatgttttcaccagttgatatcactgcgtgtgtgtggtttttatttttatttttttgagacggacttttgttcttgtcacccaggctggagtgcagtggtgtgatcttagctccctgcaaactctgcctcccaggttcaagcaattctcttgcctcagcctcctgagtatctgggattacaggcacctaccaccatgcccagctaatttttgcatttttgtatttttttttttttgagacagagtttttttcttgttgcccaggctggagtgcaatggcacagtcttggctcactgggattacaggcacccgccaccatgcccagctaatttttgcatttttgtatttttttttttttttttttgaggcagagttttgttcttgttgcccaggctggagtgcaatggcatggtctcagctcactgcaacttccccctcccaggttcaagcaattctcctgcctcagcctctggagcagctgagattgcaggcatgtaccaccacgcccagctaatttttttgtatttttagtagagacggggtttcaccatgttagtcaggctggtctggaacttctgacctcaggtgagccacctgcctctgccgcccaaagtgctaggattaccggcaagacccaccacacccggctgtgtatgggttctgaattgtggacttttaaattttcaaggtgtgtggcagaaaacgaaacaaccttgccaagctagtgccctctatcccaaatacttaaagaacttctgggtttctaaatggatggaaatgagggagagagcatggcacttagacgtgatgatttagtcctaaaaaggacagaatcaagcaccctgcagtgtgcttctcttggatggctggggcagctctgtggtgaatttccatcctccactcttttccccggctctgtcatccactctactcccagcttttagatttgctgaaagcccacctctgcctgtgctctgcaggccacagcatctcccctcttccccctcccctctcccctttcctatgaggtgaggtatagacctcttgggacgtcctctggatctctttacctatgggccccagccaacctgatatcccccatcttcctggtaaattccttcctagtttaactgtgacttttctgtacctgaccttattctaccactggtgtctgtgttcatctgtatccttccatcgggaaaactcattttcttcaattctgcctttacaaattctactcacccttcaaggcctcagcataccccttcacccctgccaccttgtttctcatcttcacgtgacctctttcaggttttagctcaaatgttacctccttagagaagtcttcccaccccaactccactcccctctgtcctgactgattttgttgctagtactttcagtctctgaagttattctattggttgacttgtttcctgtattttctacaggaagttttgagtacgtcaagatccagtctgtcttggcctccactgtaaccctggtacttggaacaggggatggcacacaaagatactcagtccgtatgtactcagagactgattgacacataaattatagtgattgcgtttagttaaataataataataatgaaaataataataatagtagttttacggctggggtagccgcactttcctccgaactctacaacttgctgtcttggcttttgctgtggattgctctatatcaagggtcacagatgaatctggataggtctgcctttatgcagatgcagagtcccttgagagggttggtattcttcatctctggatctcctttagcccctggcccaggagttggcacttggaaagctgtcatggtaaatattctgaatgaacaaatatttgaatgaatgagaaagagcagctatcattgcttctattttgcaactagtaatagtccagtttagtgtgcagacccatgccagcagcagagctgggcagaggagccaggcatcatcctctctctccccacaccctctgcatgcacttggcctccctgtctcctgctctctaggctcttaggagtacaatatagtttgtacaataagtacaaacccataaagctccctccagtatatcttgcttaaccgctcttatcagaatagaggagaactgaaagggctttcgaaagagccatctgttagttttcataaagacattatgtgcttcccatcacagggtttttgctgtctctgtcatgtgtccgccctccctccgctgtctgagagagcaggagcgtggtgcctctccactttcctgtctgtgcatggctgctggaggtgggctgcagatgagtatttatctaaaagtgaagagatctgacttataagcaagcctgatattaaatgtataaataatgcatcctgtggcattatttataatgcaataacatccctataatgtaataaaagtatgcaggttcccagcacttttcttaaccccttaatgtcttggaagatgctgtgggtttaccagcttcctcatgcctcaggggctttgggccatatgccaagcctggccaggccctggctcctaaacagctgaagcgtcttcataaccacctgcaggataagctcagtcccagtatatggggtagtgatttccaaactttgttgtgagtcagaatggagatttcctaccttcaacctactgttttggaatctcatagcatggggaggggacatttgtgtgtttaaccagctccctggtaggttctaagccatgtacataaggactcttggtcagtcctgccttgtgacagaatagactaatgagcagctccagatcattgctatgggactcaaaatcaagtcaatcttgctaggactgcactggcctggtgcctcagtttcagctcctgctcatctgcccagaatgcacattcctcctgtcactcaacatcaactgtgtgtctgaacccagccacccgctggcaggctccctcaaggccaactggtgcctaaccggtcctctgagttttgcctgctctggtattttctcacttatcaggtggcagaaaactctgggttgacccaggaaaccagtgcttacttaggtgcctgtgtctgatgtcttgtaaattcccctggtttccagactggcctgggatcccagtgctacccagagatctacctttcttttggggtctgtttctcattctccaaagtggctgtcttgtggtatctagtgtccttggatttccaatatctcccttttacaaaaaaaaaagacaaccttatatactgggacaatgaaaaaacagaacccatcagtggcatggatactctgaactttctgttcctcaccgtggctgcccaccttcaagtatatctctgcctgtatccatgctgtctgtcatctttcccaccacaatggaagaggtttatggtctccaccattaggtgacattcctcacttgtgctctggaccccaaccctgcagcctccccaggtaactctctctatagacaatctcttctctttctcctgaatcttcaacatgtttccctactggttttccatcagcttctaaacatgatcagcttctctcacccaactatcatcatttggctcaaggcttcttctagctactatcctatcttctcccccatctcaaccatatttcataataatagtggtatgtatttgttgactcttgtcaatggatacagtgacaatatatagtgaatgtgctaactcgcctagtattaattattttttttcgagatagggtttcattatgttgcccaggctggagggcagtgggctattcccggcttcattgtagcataccacaaccttgaactcctggcctcaagcaatcctctcacctcagtctcttgagtagctgaaagtacattgtacttggcttaacttatttaatcttcacaataatcctatgaaaaatttatactagatgagttaacacctaattaaggtatagagagatttggtgacttgcccggggtacatactagtgtaaggtttgatcctaggcagtctgacttcaaagcaaatgtctacatttgcctgtgaatctttctcacctgttagtcctccacgatttgatttctactctcaggtcagcagagatctctgcattgttacatccagtggggacttttggggcctagttgcacctgatagcactgacctccttattcatttttgaccttcgcttcttttgttcttgggtccccacagtctccttgttttccttttacctctctggtcacttcttagtcacatttgcaggctcttctctcttggcccaagaccttacattttgggatgttccagggttctattcttttccttctttccactctgcacactgtccctgtcttaatttgtcaactacattctaagaacctcaagtttttgttctgataactaaaccagaggtccatttgtttgcttaaaatctcaaaacaaatatttccctaatttaatcaatatttggcctgatgtcggctcttcctcttcccttttctgtctcagtcaatgaccaccaagcattcatccaattgctctggctgaaatttgcatagcatttttaacttttctgtctatttttttgagacggagtctcaccttgtcacccaggctggagtgcatggtgcgatcttggctcattacaacctctgcctcccgggttcaagcaactgtcctgcctcagccacctgagtagctgggattacaggcgcacgccatcacacctggctatttttttttttgtgtgtctttagtagagatggggtttcaccatgttggccaggctggtcttgaactcctcaccttgtgatccacctgcctcggcctcccaaagcgctaggattacaggcatgaaccaccgcaccctgcccaacttttctgtctcttttacccactctatctaaacaatcaccaagttatatgaattctatctactaaatctcccctactctcaaccccgtccactttcgcactcctcctgatgccccctgggtctcaatttccatcatctccttcttgaattcttgctaccagtttctaattggtctcttgattccagtcttgtggtcctctatacattagttatgaactatttaaagtatacagaaaattacagataatggtaaaacagacactcattcatctaccacttagatttaacaaacattagtattttgccatatttggattaactaattgaaaaataaaatgttacaaatacagttaaagagccccattcttttcttacacatctttctatcccaaagataactactgacaagctggtgtatatcttttctatgttttaaaaattcatatgtaaatatatatctacaatttgcatgatttaaatatttaaaattcatataagttatactgcatgtataattctgaaaaaaattaatattatacctttgagatttatcgatgttgatacgtagagctctgattcattcatttgagctgctatgctaaactgtagttataatctatactttccttatcagtttccctatccctggttgcatccagcctttctctgttataataaacgcttgaagagaaatctgcactcccatgtttattgcagcattattcacaatagccaagatatggagccaacctaagtgtccatcaacagatgagtgaacaaagaaaaggtggtacatatccacaatggaatactattcagccataaaaaaagaatgaaattctgccattcctggaaatgtagatgaatgaaataagtcagacacagaaagataaataccacatgttctcactcatatgtaggagctaaaaatgttggactcatagaagcaaagagtagaattgtagttactggaggttgggaagggtagtggggagggaagaaaaaggaagttggttaatggatgcaaaaatatagctagataggaggaataagttctattgttccatagctctgtagggtgactatagttaacaataatttattgtatatttttaaatagctagaagagagggcttttaatgttctcaacacaaagaaatgacaagtgttggaggtgatgaatttgctaatcaccacatattgtatagtgtatccaaatatcactctgtatcccattaatatacacagttactgtgtgtcaattaaaaagaaggttaagaaacaagcaagcatgctatgccttggcaaagaaatgtcttagatgactcagaaagtaatctgagactcaaagatacacatggagaatttaaacaaagttgttccatgttgtgaaaaaagtgctgcaataaacatacttattcaaggatccttaaatatttatgtgtttctctccttttcagggttagatcttgtatagtctgttctcacattgctgtaaagaaatacctgagactgggtaatttataaagaaaagaggtttaattggctcatgattctgcaggctgtacgggaagcatggtgctggcagctgctcagcttctggaaagtcctcaagaaacttacaatcatggcagaaggcagaggggaagcaaggtgtctcacatggtgggagcacgagcaagagagagagggggaaggtgctacacacttttaaacaaccagatctcatggtaactcactatcaggagaacagcaccaaggggatggtgataaaccattcatgagaaactgtctcccaccagggcccacctccaatactggggactacaattccacatgagacttggtgggtcacgatctaaaccgtatcagatctaaaatgagaatagttgagcattatgctataagcatctgtcttagtctgttcaggctgctataacaaaatactacaaaaaggtggcttataaacagcagaagtttcttacagttctggcatctaggaagtccaagatcaaggaactggcagatttagggtgtggtgagggtccactttctcatagacagtcttctttccactccaactgcacatggtggaagtggtaaggggtctgtcttgggtttcttttataagagcactaatcccatttctgaggttccacctccatgacctaatcactttccaaagtctccacattctcttaccatcaccttgggggatgaggatttcaacatatgactttgggggaacataaatgttcagctcacagtgtatctttaccagattttgccattttttttacaacggttttcatcaatttatacttccatcaagagttatcagaattttcattttcttacattttcaccgcaactcacaaatacttaaatatgaagagtgagaagtggtacatcattgttttaatttgtgtttaattgtgtttcatacgagaaatagagcatcagagaaggaacaaaatttttgactttccaggttatgaggactactttgattgaattaaatgggtagggcagaagtctgctgagcaggaggggcacacaaagggagaacacagtaggaagggttgaggtgggaggagcctgcacttgtgatcaggacttagaatgtgtgacaaaaactagtgctgcacatatcacctgagctgagactgggaacctcttctgactcatcctcagatggaaataaccccagtgactgctccctgcatcccacagaaaagcctgcttctggtgccttctgtttctgagttgttttaccttgcagcctctaggtggcgcacctgagttctagctgctcaggcctgtggaaagcgcagggatgactaacagaagaactgggagttatccaagagccgaggtcctagggtgaagaggtgcaggggagctcaagccagtgtttagtaataattttaaaaccctaattgcaaggggtgaagcagattataacagttacagtgatgatatgaagagcagtataatacagattttaattaatttttcattcagcacatatttgttgaatgtctgttgtatgctagcaactgttgtaggtgctgggcatgcaattagcagtcaataaagcaagacccctgcttgcagtctagtgggggaggaagataggcaataaggaaacaaaatgcttggatgcaaaggacagagtaaggcaagtggaggaattagtgatatggtagacacactaggggatggtttcccagagcagagttttgccatatgaaataggagcccaccttgcaatccagccagtggagcaggaatagtaaagagaggactttagggattggggaaaaatgtgtgcccagacccagaagtctcaaccacaggaaggagggactcaggaaactgtctgggagtcactgaatgttgtcggttgtgaagtgcagggagatgaggccacagaggtgtttaggagccgggtcatggttggacaagctatggggttggagctttatccagtggtgatgggaaagcagagggcgattttaagtgagtggatttgccagtagcatcttgggggataaactggaagcggggagacttaagctagggagactagtgggaggcagtgtgtgcagctgtccaggaggtgtcagggaagaggtatggggcctgaatcagctcagtgttactggagatgaaggaaaggaggtaggtttgactgaatttggtgaccgactgaacatggcagtgggagggacagggaggagtcctcaatgccctggcccctggcctgagtgaccattcacattgcctgagtggctccctttgccctatgcatgtgtcttcctgaccccagagtcatttttattactttcaagtgtgtagagtaaccagaactgaactaataaagtgcagcagttctgctttaatgagcagaaaagagtaatttgtaattagcatatacattatttgtacataatgagtgcttccaaagtccttatggggttgtttgtcttcctaagtatttaaaaccccacctcctcccaaccatcttgtttatgctgtttatttgtactatctgttcttaaaaatgcacccacgtgcatatgtacacactgacacattcattcgcctgcagccatctgtacattgtctgcagccagagaggcacacataggaacacgcagctaccatttcactcatttgtaaatgtaaccccacacttgcatgcaccagcacagatacacaaacactcaggtctacacataaaaatgcacatgcatgtgtacacacatgtacatgtacctgttcccttgtatatacacatgcccaggaagtacacagaacatgtactttcataagaagccacaggtgcaaacttgcatttataactgtgcccatgcacatacatgtgtatacacacaggtcacaggcctacatgcacacatgttcaaacagatacataaatctgggaggaattggggcttcaattggtctctttctcctcaagtactgatgatgtaaagctttttatgattttggtcttgtccaaagatttgaggttttggagtcttcgtcttcttgttcaaagcatcttgttcttgtgtggatcagctactgttagctaatgttacctatctgttaccctgctggaaagctggatttatgaatgatccctaaaataaaggtcctatgtgtaccacagcaataggcctaaatgagtagctgagaggtgaacttttgccgccttgggaccaggcctctgctggggcaataagcagtaaataactgtagctagtaccattatttttgggcccttacacaaaaaactctgcatagtgataaggtagactgaaaacaagcagcttctgagtagtaattgtgtaccaggatttctcatctacattgccacatggacttactctatagcattttgaggtcagaataattatccttatattacagataagaaaactgaggctcaacgaaatgaaagcatttgctcacggctgcacaaacatgggtttgaacccaggagaatctcttgcattatttaatctcttctccttagctcaccaccctctaccctgctgggtcccccaaacacagggtctgctggagcagatatgagacaaggacagagctggtgatagtctttggtgcctctgaacttgcatgaggtgtttctgcatggttgaagagcaatgatgagatgctccattcacccaagggtcagaggtggtctttcctggggaaaacatgactcagcttttctgaccttgtggttcgcttttgacatgactccagagaaggtgctggtaaagccatcgtttctctgaggatttgagtagataccacacctcagctccaaaaattaggttcgcaacaatttacaataagatatataccctaggtgaacaagcaaaggaccaggactcctttatcgtgttagaaatgtcatagttcctaaaatgtctaagctgtatggttggtcacctgccattcattggccaagcattgtgcttagatgaacctgggcataggaaaagttgaaggagacatccaggccacttttggtttacattactggaaacattttaaagacaaaaaatcatgcagatgtttttatagctattattttattttagccttaaaacactcatgaggaaagtaatgttaataacaataatggtgacaacagctgacttttatcgaatagttactatcaaccaggtcccacaatactctcaatgtgctaagtgcttcacgtgcaatagtctattcaattctcacaacaacccaatgaagtttgagtcctacagtgggttattactgctccattttcctgttgaaaaataaagaatcagtgaggtaaagtgacaggggcagcatctgcggtagaatccaggtctcctgactcttcagactgatctcatgtcctagtaccatccagggtcagagactgcaagggcaggtggaataaggttagggtgctgggaacaatatgctggtgtgtactccagcctctgtggccctaaaactgtcacaagtgatggtttccaaccaagtcaattgggtgtctgactttcatcctgggaccaggaaagtggggcttcacgactgccttgatggtactggtttgttttacagtgtttgccagtttctgtggtgtaaatacttacactatgtctgatttcaagctagcaactgtttagcaattgggagagaaggatagagggagaagggaagagagagaggcatttgcttacatcatgtctgatttcaagctagcaaccgtttagtgattgggagagaaggatagagggagaagggaaaggagagaggcatatgtaacaactgcatatttaacagttggctttctggctcctccagccgactgcttgggcccaacaccctagcaattaaccttttgctactcctgggctccaaggaggccaggccgtgggaacagagcaccagaaggatatttcaaggcagtttctccattgcctcagcctggatgaggctgatagtgttttacttcttcctttgcctccctcagggagaaaacaaagagtggatcccagaaaggccagggcctctaatctctcagtacaagtctttgaaaggagaggaagggagctgggtctaccgcagagagctggcaaggctgggtctctggaggctggggccaggggctccgcgtgtggagtatggagcagagccggtgggctgggaggaaacgactggcggaaggcctcctggaccctctatcctgtcttcataactcccacacagattaatgagcctcaggatgcccttggttttggccagccatgcttggggcctccccaaaatagacaggacgcccagtgcctcttgctattgtcccagctattgtctttatgagcctcctgggttcagggatcacatcctaactcttcctgttcgtgcttaatcaccatccggatggatggacacttgcagacagactgggggcaatgcagactcagggaagccagtactgtgtgcgtgtggagagatctggccccaccgtgtccatggctgaaaagggagaaatggggccatggtggagcttttgcaaagactcagcgctcctttcttggctgaggctggctgagggggccaccaggctcagagctggtgccctggggtagggcagtgtatggggcagagtcagccactagggggcaggccccgacagcaggtgggccaggcaaaaccctgtcaatgctcaaaaggatggtgggaggactgacagccacaaaaactgacccgcttggggtcttggggccccctccagggtctggtcagctccagagagaaccaacacccaggggagtctgggaagcaaggacagcagtgatgggaagctatccgtagattccctgtatcatcctagtctggggtgatggaactgtgatgagccgcatctgcgtctggatggggatgggcacgtggcttccccctgctgtggaagatgcaaggagcaggaagaacagtgacagagaaggacaggcctggggatagggtcaggagctggcagctgcagccccagcacaaaagccagatgcaggaaccctggcttggggtatacaagcccctgaaggggcctttttggtttgtatcctcctgggcctgcctggccaggccagcttcctgttagcctagcaaagctgagatttgtcagctactccaaagcagtccctgcccttcctgctcttgactctgcagtattttgccttggttgattctggcagcttgtgagccctctgagcctgctgcctgccccggatgaagctgtctgaggttcagctgagctgtctgaaagccagagaagcttaggatttaccctgagggaaaaagactgggatgcacccactactgggaggcctgatagacccagtgacctatggcaaaccatttattctattcagccattctcccatccatccatcccctccatccatctagcccctcatccatccatccttccatcaactcacccacccagccacccacctacccagctactcatttatctaccctgccatgtatccctccatccttttccatccatctgcccatccttccccattcatccatttatcaatccatctattttccatccatccattaatctattctatcagtatatgtcattgaaacttcctctgtgccaggctctcttttgggtcctgagaatgcagcagttcacatgacagaaaaagtttctggatcataagagctaaatttgaatggcaatgtcccagtgacaagccaaatcactcactatgacataaggatggaaattgatggctcagctcttaatccatcgaggcagcaaactccctacacctcttgccctgatacatacagatatatttacaatatgtatgaaggcaccccaaaatatgcatacctgtgtatgctcacattgcatccccttggatagcaacatgtcttcaggataatttgtgtacacataccaccatacccgaatgtataactatctaaatacgtgcatgtgcatggacataaattcacatatgcacacatgtacgtataggcacacaaggcacttacacatatttgcacatatacatacatgtgcacatatacatacttgtatatgtgcaccaggaacacacaggtgcacacacacacacacacacctgtgcacagctactcaggcacattggcatatgcactttaacttcatacaaatatatacacttgggtacagtttggatctgtatgcatataagatacatgtgctcacatatgcacctatccatgcacacaggttgcatgtacatgagcctacacatgtgcatgtaaatactccctctgactttgacctttcaccaaaacccccgaaccctaccatttccccattctgtcctggggaattatccatatctctgacaagagaatgggttactaatgcagccacagagctgttttgacacttttgatgaataacattcaatactattaattggaacaattgcttttcatttaactaaatcatgggaattgctaaactaaattgaaacggaatgtgattttgcttcgcactgctttaatatgggcctctaaatgtcttctctctgaaggattagtaacttaatcacccaccagtgataactgcttcccaggctcagccgggaggcttcctgctcagcagcagcctggctggtgaggaactgggggcccaatggcaactactctgccccttgcttcctctccctgcattattcatcgtgggggaacacggttctctcccttctctgagtccagcaggaccctcagagacaatttccattttccctgggctctgcctgtctgcgtcctgtcgaggagctctcattccaggatcctggatgtgggcgtggattctgtctctgagcttctctgagccttgctggaacacttcgtcctgagaacactggctctggaatcctggggccacgtataccctgagggcagcccagtgcctggcttagcttccaggggcaagttgatgtgggccagaaatgttccctgcactgcctgggggagcagggaaggccccagccagctgggctgttgcagggtgaccaactgttctggtttgcctgggactgaggggtttccaggacatggaacttttcagggctaaaactggaaagtccctggcaaatcagaacagctgatcatcctaactgtggtgtcatctgtgcctccagctagaaatcatgtttaacatttattgagtgcttactgtgtgctaggtgcttgacatacattatttaaatgttgtgacaatgttatggggatatgttctattaacatattcattgtataagtgagaaaactaagactcagttattttttaatcttatctatgtcctcacaggtgtggacacaacaataacaacaaggataacaaggataataggagctaattttataagagcttgctctgtgataagcacttctgctaaaggctcaatgtgcatcctacagcaatcttgaagttaggtaccatttttgctgttccttcacagaagtgaaggttattgctagtgagtgctagactgtgattctagacctagcagcgtctcccaccagcctctactgtgttggcttgcctgttaggctacatggggcctcccaagtccttttcctctgggtggtctaaggagacccaggctacaggattctggagggtgaggtccttagcaaattgagttgctgagcttagtgtggcctcttctaggtacagcttctgtccttgggtgtgcaaaggagacatggccactccctgaatagggatttcagggacagccaccccacccctttccactgacacggttcctgacactgggtcctctgagtggatttggcatgtgattgtggggcctgtgagttcttataaagccaggttcttgcctgcttctgctgatctaggacttgtttggactgcagcaacttgtttgccctgcagcatggtaggttgccgtatctgcctctccatcctctcctcctccccagccccaaggttgtcaggaaaaattgctaaatttggctctgagttgtcactccaaaatatttacaggaagagaaaggagcctgctttaagggggtccttattggaccactcctaagggtcaggtactgtatcaggcatttcggtttatgttctcatttaatccaacaacatcccaacagttaggaattattattcccatttcacagttcagagggcaaaggtgctgaaggaggcccaagttcatgcacctggtcagtgctacaccacagtttaggaatcagactgtttattccactgactcaattctcttcctaggcagatactgccattctctaaagcgtagctacttccgacctccaagtttctctgtctctctggagagggctcagtgtgctcagtgtgatgatgaagcttgcaggctctgaagacaaatgaatatggcctgatgcctggtgcttcatgaggcattgggttgagatctgcttgtctgttggagtctttatgtgtaaaatagggattcacacagtcccgacttggtagccctgttgtgttggttgcacaaagaagagctcagcacagggcctggcacagggcaggggattaataagtggttgctgctattatcatgtttatgatttctggcagtttgaaaggagattctctggagttcagtgctgtagatgtcaagccttgcctcccctccacatctacgctgcctgcgcccttgagtttcctattaacttaataggcctggacgtaaaggagccagttgttcatgggatcccagagtcaatcaacaatccacccttcactgcttccatttggtaaaatcgatatgtgttgattgaacactgagtctgcgcagagccctgaggctgcgcctgaggaggattcaacctctcgctgtgccagggagtgtaactaagatagcgttctctacctgggatccctggaccagcaccatcggtatcatctgggaacatgttaaaaaaagcaaatgggcctaccctaaggcccattgaatcagacattctggggttgggccccaggaatgtgtgttttcgcaagttccccatatcactctgaggcacgctaaggtgggagaagcattgctccaagagaccaaaacgcagctgtcctctgacaaggaccagctaagcctgtgggagcacagagggaagagaggaggacccagctggggaacctctggggagtggggtgccctgacaaattctttcttcctgctcgggcttgggaaggggaggagccagggctgcagtgagtccgcctggcaccttcgaccgattagacaaaggtgccttttcttctgcgaggatgcagcgctgccggtgaggggtgcgtaggctgggttttcatctcatttacccttcacccacatatgcaaggcccaggcaaagtgtatgataggcctgggtgcatttgacaggggaagagccgaccatacctgtcctctgacggtggggggtggctcctggaatgctgagctagcaaccatggtgagtccccctactgtgtggacccttgccaggcctcaggcctcagcagtcacttacataaaacaggtggtgaaggccaaagcctggggagaaagaggataatcagagtcaagtcatgaagacagcatgccatgggctggaggagatgtcccaccctgagccaccacaggagaaaataaagcaaatgattgacagcccctaaatgtgcgggttcctctagagcactgtcctcctgccacagacaaatcagctggattttgatgcaaaagtcaaaccaaccaccgagtatggctgaggaggaagagaaggctgttgccctcagcctgccccagtcagtgccacacagttagccttttacttccttctcctttcctccctctctccctggggaccctctcagaccactctcccaaggccagctggcctcattcccatcctcccaacataggctaccttggacttcaccacctctagattttggcctgcaggagcaccgctctccactgagagcacttgctgtctcccttacacacctgttcttggtggccagtggctcctcccttctccttggcaggtgtcctaggttttgtcttctgttggtttcatggaacactgccttaattgttcctggggctttaatgggaccctgtcctcttctacattcttctctctcccagaaggtgacttcttgtaggtagggggtacttgagtctcctcctctgttccccttttgtcccccagactgggaactttttatagcaaagttaagtctctccctgtctctgaaccagttctccactccaacatttgctaccacaagttttggacaaagtagagggagagggagcccacccaagtccagctccaggggcccctagacctgctttgttggccctgtctatgtcccaggtaccacaattgtggcaggtcactctggagggactagctatcctacagccccagacaatggtctgggttctcgttccctatctcctacccctcaccccatatacaccccgtatacccacacagcatgggaggtcactaaaactcatcactctccctggaggaagcctgaagggcagctggactaagtgcctccatccaacacccttggaggttcacacttatttctgttgtctccataccaacagtgcatcaactctcatcttttctggcccaaagttggataaagccccagctcaagttctcttttgtagactggcaatagagttgagaaatgtaaagaagacggatactaaaagatgaagaagtagaacttccaggagaaggaagttcttaggcagttcgtggatggggctctagctaggtgtagtgaagttagaaatgtgtactttctaagtcagacaattctgagtgtcttgtatttactttcatgtttctcagtgatctctaacatttggtccatatctcacatccttgcccttctccagaaattttcttctttgatgtcgtaactattttctggctcccaaaatcaggtgaacctgggtaccatcttccctgggtcctatgacctctcttgctgtgagatgccactcttctgcctcttccccactctctgtctccatcttctcttctcttttattgacatgtcccaagggtgctcttctatgttctttgatctctcccatctgtcttgttcacctaagctgtccctttcgtctctgcacatagctcccaaattccaattcttgcttctaagaaggaccctttggaactgagagctctatggagctaccctccagcataatcagttgcctagagacattttcaaatgtagtcccggcgagtatctaaaatctgacctgcctccaactaaacccaatatcttccttctcactagcagtagcttcctgcctcactctttctgctaaaaagtttcacccagactcgaaaattaatgtgtttctttcttgtccctattttcttctaaaaatctgatcggtaagttccagaatttccccaccgtgtcctttcctctcctgtggactgaacccctccctggctcacacacttgccccactgagggcttcctcccattggcagcttctatgccattcatccaaaacatgctgcctgccaaacttatctttttattgcccagcaaggaccatgtccctctgctacttaacaatattctagagcattatgccaacttctccctgaatcctttcatttgggaggttcctatgagtatagagcttagactataaggccagtcagacctgggtaaaattctgactctgccattaagtgagcccataggagagtaaacacacagcccttaataaatatgatttccctgatttattcaagtacaagtaagtttacttttacttttcataattttatgtctcattcgtacttctcttttggtatccactacttttttgtatctagctattttagtatgtattttctttttaaaattaatttcttaagcagaacctacttagatattttaaaatgcaataaatattatgtagaaaattagaacatattaacacatacggcctcagtggccaaagctgtaatcagatgtcaattcatagctattcattcctttgctcttacctggacaggagacagctactgaccattaaaatctattgtctctttccttcattttaatagatgtgctgggtacatggttactcagctacactttattttttattttcccttgaagttagatgtgattgtgtgacttatttatttaccatagaatatgagcagaaatgctttgtgccatctcccatataccccctctcatatattcccctctgtgttttttccctttttggctgattgagatggcaaaaagtaggcttggaggccattcgttgaagatgacattgtcactatcagcctggggtcctgaaggacctcgtaggacagaatctcagccacttggaacctctgccctggacagttatgtgataattataaaatcagtcttgcttttaggctactgaaatgtggggggtctgtttgttacatctgttaatagttagcctacctactacttactccccatggtaggcagaactttggaaaggtcccattctaatatccagaacctgtgataaatacaaggaaatatcattctcatgattatgttatgttttatggcaagttgaccttaaaatagggagattatcctgggatatccaggtggagtcaatgaaatcgcatgcgcccttaaaggtagagaaacttctccagcagttggcataaggggaagccagaaagactcaaagtaggagaaggagtcaatgtgccattgtcggttttaagctggaggggcctgtgagcaggaatgtggagtcccctatgggcagagtggcccctgactggcagtcagcaagaaaccctggaatccagatccagaactgcaaggagctggatttttccaacaacgaagctgaagctggaatcaaattcttcccctgagcttgcgcgtcagagtttaccctggccggcactgtaatttctgtctgtgagacactgagcagagatcccagctgagcccacctggattttgacctatacaactgtgaaataatcaatggcattgttttaacccactaagcttgtggtaatttgctatgcaaaaatagaaaaccaacacagtcctttagaaggcaaggactcaaatcttattcttctctgctctctctgatgtctcagggtagcacctggcatgtaagaatttaggaagcttttgttaaatggacaaatgagttagtgtggtgggtgagtgagaatcctcaaggtatagatccaaggtctgtaaacctttttcatgaagggcaagatagatagtaaatatttaggctttgcagggctctgtcacaactaatcaactctgtcactgtagcacaaaagcagtcatgatgatatgtaaataaatatgcatgactgtgtgccatcgaaggtttatttaaaaacaggtggtaggtcagatatggcctgcatgcaggagtgtgctgaccccttttatacatcattggaagactttgggtactttcatccaaagatggggaagcttttgcctagaaccacaagacttaaataaatggcttgagggcagaaatagtttctactgtaagaaatacatcatcaggcctgagaggtggtttagattgttccagagcacatggaactttttggtttctagggagataaatcccattaaaaagtctcttttctttctttggctttcaagaattcttctattaacatacccttacctggttttcccttcttacaatgagatgggactggctctctggcctggcagaaggaccctagcctgcagcagtttgcagagtaagggatttactcagctggttttcagctgagcccccgccccatgcctgaagcctgagtgaatgtctccagccagcccctgggcagagatggtacattgcttatgggcctgcctgcccatccttcatgaatttttattaaacaaaactgtaagcagattgattttgtcctcttttattgcatttttatttaattccgttccatggtggaggctccatcatgttaccgcagagtaaatcactccagggcatcaggccaaaaccgtggagaagggcaggatctggcttcccaagagcacatttaccgcataagaacctttattagcagagagccattgatttcttttttttttttttcaggtcatagccccttcacatcctttaaataagaaagaatcacaaagttatagtggaagagagactctgtgtggccagggtcatggggtgctagcttgtgtccaggtctgacaacatctgtactacccgtaccctcaactcagctcctactatgtgctgggtggggtcatatgaaaagcttggagaaaagtagtttgggtggagcattggtggctgatacagatggaagggaacattaggtccaggaacaaagtactttaatatactttttaaaaaaaattacgggtggttatagtttagcctcagacctttatgtaaaaagtcaagactgtgacagctgtaatctaaatctccccctccttccatagctcctactttcacactccaggtaaaggactttgggattttatccttaggaactagagagctactgcctgttttagagcagggcagtaacaggatactattactatctttgttagaggggatcaatctggcagcagaatgtaaactgaatttgaggagagttcaggagtagggcagggttggaagctagaaatgggggcatcagttaataggatattgccatggtctagccacaaggcaacaagaacccaaagttgaagtaatgaagttgtagaaatagtaggggagagagattaaacaacaaacagttggaggcgactctgaggttttgtcaactgcaaaagggagtgaaaggggtgaagtggtttgagcaaagaaaaagcagagctgagtttggtacatgcttatttacaaagtaaaagaaatacttatatatgtatatacgttattgcaaatgtgatgcagataaattgcagaaaattaaaaaatggagaaaagcattataaagaaaataaaaatcatatttaatcccacaaccacagtttgccattgcaatagtacgtttggtatatttctttctagatagataaataaacagatggagcatggtactaagtagtcttcaaaaatatgattctcactcgctgcgtattaccatctggatacaccaaaattgatttcactgtgcatcaattgttggactttaacttgatttatagtttctccacactataaataatgccatggtgaacatcttgctgtatgcttctttgtctgcctctctgataaatttctaaagtaaaatgattgagttaaaggttataatcttttttaaagttcttaactcatgttgtcaaatgctcactcgatacttactgatacagtgtatgttcaggttgatttcacagcacattcatcaatcaacactagaattattttgatttttttaaacccttggcaatttcacagtataaaagggataatcactatttcttaaattatttgttttttattattactaatactttaataataattttgggtgtgcctattggccattttcaatttctcctcttttgaaaattgtatcattttttcatatttctgttggacaaaatctgttttttatgtaccagtttatgacaacttttaatagtggggctattacagttttgtgtattagacatgttgcagttttttgttttttttttttttttgccacattctcattacctttcaaagttttatatggtatttttgataagtagaagttttgaaattttatgtagtcattgctatccccttttggattttttttccttttctgttatactttgacagtccctctcaaaacaagattcagtaaacatttacctatgatttcttttaattctttgtgatttcttcatttgtctccttatttgaagcatcagcctgtggtgatcatgaacacaggctctggagttacatggacttggatttggatgctggttctcccaattacttgctgtgtgaccttggataatgcttaacctctctgaaactcaattttcaaatctgaaacagggttggaagttgcaggagataatgtatgtcgaagtgtccagcacattacttggtcagtagcagacatgtaatcttaaatattgccacgttaggtctctgttaagtatgtacaattttgatcttcatgaaggcagagacactgtcttatttacctccatatcgcatgtctaactgaggacatgtcttaaaatatattttcagtgactatttgatgaatgaatgtatgaaatgagcttaacagattgcattttgtaagttgtaaaggcaaaaggaattcactttaagacgtcgaactcatttagaaagaaccagaatagttactgtgcatctagaatgtaaggaaaaaaagcaaacaagaaacaaattaacactgttctttcattagctacagctcgccattcagtcttgtgggtctggtcagtcacctttgacccctgacctcttgccttgacctaggcatacaggccattgccaagctctcttgagtctgtatgtagagagattttaagagctcatagggccctctgaggtcatttggtcagctcaacttccagtatttgtattttagttgtcaagcacttcttttctaaaggaatgtgaccctgaaagtccaatatgtaaaaacagactgaggtagagatgccatgattgaaacacaggatcaggaggtcatattccttctactgagggctttgcagatgccgttctcttggacagaaatgcaattccatcctccctgtcccaattatccggctaagtattacttgtgctttaggtcctagcttaaataacactttcttcaggaagccttccctgaccttcttttgaccaggtcagttttcccttctgtatattcatagtcctgttacctctatttgctagcacacgcctcagttgcaaatttgcatctattaatattaatttcctcttacactaggagcaaaatagaggaaagcctgtgatgagtttgtttactattatactccgggcactcattgcaaggcctggcttgcacacaattggtgtcacttaatattaataccttaatagaagtgtatctgatttaatcccattcttttccagattgcacaaatgctactgtgtccactgcatgccagatactctttgagtactggaaatacgctagtgaaggaggcggacaggagtatgcgtctagtcaggatgacagacaacagaggaatcattaatttcaatggtgataaatgcatttcatacattggacctctatgtaatatttaatcagaagataaagttcttttactgaaaaataattagtaggtttctaggccagcacattttgtgggtcatgaagtcagcagctaagagtggtacttggaatcttgtctttgtggttcatttagggtgggagagtgtctgtgaggcccagccaccttgtcagaatggaagtttcatcacccgctgatgagtgttagacagtgcgtcagttcatctcaaagttgccaaaatatgcacctacctgggtctgctttgataaatagataagaacttgtgttccttgcgagtccatcagaactcagttatcataatcatctgtcacatgttccttaaccctatgggcaattctagggaggtggctgatctagatgaaagaaggtccttcagcaactgtccagggcacttggaagaatatccaagctccccaccatgacctatgggcctgtgctgatctcggtctcttctccctgcccatcttcattttgttccatggcctctcatgttgcagatgtcaatctcaggtcctatttgaattattcccagttgcaaatcaggaaggtattaattggtgcatgttctgtaagtgctgttagaattagagctactgggctggctgacaggagtttagagggcagcccttttcctcctctgagcctgtctccccagccatcccttctaaaagttgctgggctgatgcttgtatcttggctggctctgatgccagctctgacggggccaccctggaacctgcttgcacaggctgtcgagggcgtgagaacccaagcagacaactcccagtcctacctcctttgctgtgccaggctgccagtgccagctgaggaggccccctcctgcctctgcttgtttcccttgattgttatgtaatgttcggcagcaggaggtaaattcctctccaatttccaggcccgttacagcgcatgaaccccaccgtggggagccacagtgattgagctcagcagccaggtcccatgctgagtgtcataaatcaggcctattaccagcttctcctggcagatgccatagccaagaacctgcccactgcttgcgagacccagccgcctctgcatactgttaaaccagggctgacagatccaccggggatttaggggatcttcatgacactctggctgggtgttgccaggaatcttattctgagagagcaggaggtgacacagcccttggcaaggcatctcagacctgagatctcacagcctgatgtacggggagcagaatcagggcatgatcacctgcaggctacctggatttcctggtatggtggcctcttgtgtgcctggctgtacacgtaagaacctctaggggacttgttaaaaaatatacatctcccaggtccatccccagagattctgatttggtaagtgttccttgggacatggaaattagcattttttactagatcccaggtgattctgatgcaggtggttcctggaccaccctttgagaaatgctgctttgggaccagctgtatccctgaagtgatgcctgtaaaatgaatgcctataaattgtgggtcttttttttccatttccttctatcatttggctgaagatgtgtttgcctggggaagaagatgtgggcttcaagaatcaatggcaatcaaactgaagaataagacaaatctttgactatgacatatttaaagggcaataataatgctaatagcaaggggaaaagtcccgtagtaggatgttttgctgatacttaacgtgctacagggggagctctatccttgtttctcattggctctgtctgtatgaccaaggttgtcatatgtcctggttatcctgggtcagtccaagtttatgcaggttgtcccagtgcaacttctaatagttcccccttcgactctcgaaagtcccagtctggatgacagttgttactctgtcaataacccataggattgcttcccttaagacctccacttttcttccaaagggatctgccctatagttgtctctgaaggattttgtcagactgatcccagtagtggatttcacactaaagttcaccctgactctgggctgggatgaatggtaaaaggaactctttgaccaggtaatccccctactctttccaggaaatcccggtggggaaaaggaaggtcctatgacctgaacagaagaaacagaatttggtggccagggaaagccttccctgggggtccacccttcctgtgacctgaacagaagaaacagaatttggtggccagggaaaaccttccctgggggtccacccttcctgtgacctgaacagaagaaacagaatttggtggtcagggaaaaccttccctgggggtccacccttcctgtgacctgaacagaagcaacagaatttggtggccagggaaagtgttccctgggggtccacccttcactttgggtgcatgagataagactacattttcctctcaaatatcataataaaaacattaataataagtcctaataatccatgagatgtggagaagtagataaggagttctagagttagacaggctagatttgattccagcactgccctcacggacttgacttcaagcaggttgaccatgtgggacctcatttttctcctctgtaaaatggggataaaaatcttcaacctgggagaggacttgagatatttgtaaagagcagacacttaataggtagtcaataaatggtgatggttagtataatcatcatgacaatgacaattaaaaagcaagatttaatgttttaaaaatgtttcccaacatatttcttctttcgaaggtgggggcagttaatggttttatttctttatcaatttcctcccctggaactttccaccatgaagggtaagctatgaggcttctctgaaaaacaaagagaagattccatttagaacaaaaaaacccagcatgaacatagaaaacccagtgtgggttagaaacacccaaacatttctagggaaactcaacaggagaatttatttctcaaggattttagcattgcatgggaacttcccaggcccttttgtaaagtcctgaatttagcaagatgctggaggcatgtggcactgaaaagaggttaaattagaattgggtaagggaagagttcgggagacatgcccaggacagcccccacactgctgtggcacctgagatcctatatgccgcagcggggacacacgtgctgagagctcttgcagacatgaggtgtctgggatcacaacaaagatcctaccatgttggggactttatgaccagaggctgtggctgtgcacctcagtcacgggtaccaatgggacgcccccaaagaaccatgtgagaccagtcacaccttggccgatgctagcgcaatgctcaaaaccaggtcagaggcccaggccccatacagtgatgtttgtttccatctctacttgggaaagagttggggcatggagtgagggtgggggttatggggagtcatccctttgagagagcaaaggggagatttagattttgccttgaccaaacatgctaaatgagactatttacatacatatacatattttttgaactttgaaagtctttatcacagtattgcatgtgacagaaaattgcagagcctatatgtttaacaagaggcaaatagttaaataaatgttggtacaaccttgaaagaaattactaaaagccattcatattcatatggtataggagacaccttcatataatgacttggaaagaaagcttacagttcgttaactagttaaagaagtgccccagagctctgattggcaggagatagaaatccagtcagagcagctgaagtgagaagataaattataaggtatcttagctcaggctgcctagaagcagagcctgaggcagggtttcttgggcaaatgatgtaatgaggaaacactcttgggaaaaggagctgagggaagcggggcagggcaggggatggtgctaagagaggatgtggtctctaggtgaagacgagcttcagcctgatcccatagggaactctggtgtataaagagctttatagaattgacaccaccttaaggcaaggaggctagccccgcgcacagaagccaggtgatgggtgcaccagcctgggcgaggagatcaaggcttggtaccaacagcatcaactacctaaagatagactacgtagaaaactgagaaaagaactgaagtgcatttgggctctgcaggagtaggcctcctctccttctttctgtatacctgctgtattctcctctcatagaatgactccactgggcccacactagattcatgaactaaaaggcagttcatatacaacttggtgagttatgtgatatggtttggctgtgtccccactgaaatctcaatttgaattgtatctcccagaattcccacatgttgtgggagggacccagggagaggtaattgaatcatgggggctggtctttcccatgccattctcatgatagtgaataggtctcacgagatctgatgggttatcaggggtttctgcttttgcttcttcctcattttatctcttgctgctaccacgtaagaagagccttctgcctcccgccatgattctgaggacttcccagccatgtggaactgttaagtccaattaaacctcttttccttcccagactcaggtatgtctttatcagcagcctgaaaacaggctaatacagtaaattggtaccagtagagtgggctgttgctgaaaagatacccaaaaatggggaagcaactttggaactgggtaacaggcagaggttggaatagtttggagggctcagaagacgacaggaaaatgtgggaaagtttggaacctcctagagacttgttgaatggctttgacaaaaatgctgatagtgatatgaacattaaggtccaggctgagggggtctcagatggagatgaggaacttgttgggaactggagcaaaggtgactcttgttatgttttagcaaagagactggcagcattttgcccctgccctagagatttgtggaacttcgaacttgagagagatgatttagggtatctggcggaagaaatttctaagcagcaaagcattcaaaagttgacttgggtactgttaaaagcattccattttaaaatggaaacagcataaaaattcagaaaatttgcagcctgacaatgtagtagaaaagaaaaacccattttttgaggagaaattcaaaccggctacagaaatttgcataagtagcaaggagcctaatgttaatccccaagaccatggggaaaatgtctccaggccatgtcagagactttcacagcagcccctcccatcgcaggcctggaggtccaggaagaaaaagtggttttgtgggctgggcccagggtctccacgctgtgtgcagcctagggacttggtgtcctgtgttccagccactccagccatggctgaaaggggccaaggtagagctcaggctgtggcttcagagggtggaagccccaagccttgacagcttccacatggtgttgagcctgtgggtgcaaataaatcaagaaatggggtttgggaacctctgcctagatttcagaagatgtgtggaaatgcctggatgccctggcaaaagtttgctgcagtggtggggccctcaaggagaacctctgctagggcagtgcagcagggaaatgtggggttggagcccccacacagagtccctgttggggcactgcctagtggagctgtgagaagagggccactgtgttccagactctagaatggtagcttgcaccgtgcacctggaaaagctgcagacactcaatgccagcctgtgaaagcacccagaagagaggctgtaccctgcaaaaccacaggggcagtgctacccaagaccatgggaaccctcctcttgcatcagcatgacctggatgtgagaccttgagtcaaaggagatcattttggagctctgcgatttgactgtcctactgaatttcagacttgcatgggccctgtaacccctttgttttggccaatttctcccatttggaatggctgtatttactcaatacctgtacctcccctttgtagctaggaagtaactagcttgcttttgattttacaggctcataggtggaagggacttgtctcagatgagactttggactgtggacttttgggttaatattgaaatgaattaagactttgggggattgttgggaaggcatgattggttttgaaatgtgaggacatgagatttggaggggccaggggcagaataacatggtttggctgcgtctctgccaaaatctcaacttcaattgtatctcccagaattcccacgtgttgtgggaggggcccgggggaggtaattgagtcatgggggccagtctttcctgtgctattctcatgatagtgaataagtctcgtgagacctgatgggtttatcaggggtttccgcttttgcttcttcctcattttttctcttgccgccaccatgtaagaagtgcctttcacctcccaccatgattctgaagcctcctcagccatgtgaaatcgtaagtccaattaagtctctttttcttcccagactctggtatgtctgtatcagcagtgtgaaaacgaactaatacattgacttgtccagcatagctggaagggataaattgggtcatctagatcttctcttagcaattatgaattggagaataattattgaaccagctagctatagaagctgaactgaactaaagggacaagaggaagcttggacctggggtggctaccttggtcaatttatgtagtgaagctcaagagaagtagagacagaacaagtgaaataagtggggctgcacacaggtgcctcccctacccagggcctcctttgcttggggtttggtttccacttggcctgggctttggggagtatcaaggaatggctttacacactgactgatgggtgctgagggactccccagatttatctaggctgatattgtgtagtagtaccaaagatattgatggcaattaagataataataaaaatggagatagcaataatgataactcgaagtaaggacttgctgtgtgccaagaacattcttaagcactttacctgtatgttatcatgtcttccttacaacgactccatgaggtaagaactattattatcttcctattatagataaagaacctgagatccagggagatcaatagattctcccaagttcacttggctagttagtattgaagtctgaattgaggtttagccagccagacccaggcatgctatgctatactaaaattatgcaccctcatacacacacatgcatacgaatgggccctggattcacacaactctcgagtcaagctctccttattcttattctactccagcaagcatctcaacctatcttaagctcaattttcaggggaagtccctaacacagtgtctgacactcagtaaacgtatagtagccactcagtagatgtgtcttccttcgtttgattcttcttctcatgtctgagagagtgtttgggcatctacatttacataggggtcagaggtgagcactggtgctttgtccctggctttctactctggcagagagagcacattttaccttcagagaggcaattagaccccagatggcagcactgagcttctgcacagtattggctccccagtggactaggcagaagaacatcacctccaggatccccctcaggtgtgggtgtgacctagttactggatggttgcagagaggacagaccccagttactggatggatgcagagaggacagaccccatgggggagtcagggaaatgagttgagttccagggggctggtagctcccacactcacagagtggagtgttggggatgtcaggagccctcatctctgatctgagcctgtccctcccttctgctctttccctttttcccagccccaccttctcactttaagtctctctatgtctctctttttcactctattgcttttccttccccctcctttccctttgctctttctctctcctatcttccatcctttgcttttctcctttgttcttcccccacatcttgccatctttgctcagctgccctcccctctgactactagcctttgtcttactaattgggatgggcagttccatcccaagctgccctgatttgacccctgactgtgagggctttgatagtccttgagataacagcagcctctgcccaaatgaggtttctgtcttgaacaatcacattgcctgcttggtaatgtggtttcggcttctgtaaaatggggacagagctggtgctggaccaaatccaattccccaacttgactttatacttgaagagtgtgcgtcttccacacaatgtgaaactatatagcaatacgaatgaacaagttataactacacccacagagaggatgttgagtaaaagatgcccagacacaaatttactgaatgattacatttatagggagttagcaaaactgacaagaggcatctatggtgttagcagtcagaatagtggttacccttgggggagtagtgacagaagggattttttttctggggtgctaatcacactccatttcttgacctgggtattggttacatggtggtgttcacttttgaagattcttcaaactattcatttgtgatttgtacagttttctgtatttattatagagaaaacattaaattatttgaaatggaccaaaacataactgggcatttttaatagaaatcaaggtgtctaaaacacctgttgtgtaataaagaatttggctggcctttgctccttgttttggagagggagcctctaatcccttggaatttttggactgttaagaatgtgtttgttattcatggcttgcatctcagacacacctggcttcatgctaatgaggtgactaatggtggtccctagatggtttcaggatgggagctggccacaccagaaagaccaaccatgtgattaagaggttggagcttttagtgaagtgatgtcagtttgacctctggggagtggaggcaggttagagattgagttcagtcacatggtcaatgattcattcaatccatagtgaaatcccagtaaaaattctggacattggcgctcaggtgaactttcctggttggggatgcacatctatgtgctaagaaggtagcacatcctgaggatgtggaaaccttgtgtctgtagccgtcccatacttcacactgtgggtctggtctcttctcttggctggtcctgatttaatcctatgtaataaagctgtaatcataagtatagcactttcctgagttctgtaggctgttccagtgaattattgaatctgaaggaacctctgagtttgtagctagttggtcagaagtgtgggtagactggggactttcaagcttgtggctggtgtcttaaatgaaggcagtcttgtcgaggactgtgtcctttacttgtggagtttgacctgattctaagtacggagagtcagaaatgcattgtggtacccttctgggcaatctgatttgttaaaagaaaacttcaaccaagttaaataagagtttaattgagcaaagaatgattcatgaattgggcagcctcccaagccagagtaggctcagagagtccagcacagccacatggtggaagaagatttatggacaggaaaaggaaagtgacatacagaaaataggagtgaagtcagaaacagccggattcgttacagctcagtgtttccctcatttgaacacggtttaaacaatttaccacatttgattggccaaaactcagtgattggcagaagagcaggctacagtctgtttacaattccatttagattatagttcgcaatgtactgagaaaactttaggctgaccttaaaatatgtaaggaggaggcagctttaggctagatttaacagattctataagggctcagtgacctttaatatctttgagcttttttatacctttgtaagttgtagttaactgaaagcagtgtaaatgatagctgcccatagatgtgcacattttgtctggtgatagagggataatccctcttcagtactcccaaagccagttgtatatctatttgtaaattcatttcagcatgaactgaatcaactataaaagtgtgatactttgagttatcttttgaacccatcataacatcttactgattccatagttaataggttaaatatcttcagcatattttcattttatatttgcataagagtcatgattgtcttttaaagtttaataatgttttatacttcaataattttttttaaaatatgcattttcccaggccctatatgagccatactgatccatcatttctgggattggggctacaggaatctgcattataataaattttctcagtgattctgatgctattactcatggcctaataattgaaactctgcactagacaatagccaaggctccctgtggcttcggcacatcaggatttgagagcagatttgaacctccaaggttatcatttgacgccatttatcttcatcctgtttggggttttcattcataaaggagttcctggccaggatttgcaaaagaaaataaaggttacacccttgcaaagcggtgtttggaaagccttctagccaagacttttccttcattctgttctggagtccaaccaaagaggctaacaaagaatcaggcagggctgggctgtgactcaggccaaggtagacagaagctgaagagcccccacttacttctatgccactttcttattaagctgcagccttggttttgcaatggaattattttttttttgtctttcttccttcaatttctaatgcaaacagcaatcctcagaaaagcaacatttattaaatcaggagaattacaatatcaatgggaagttatcatgcaataaccttctattgatttgtgtattgccagtaatgaaatcaactggaatattatttattaaacatattgattagcaaaaaataatttgcaaggatggaagcctgactctacaggggatcccactgagttttgagtgtgtatctgcaattttttccttttgcttggggaagagctgtagtgagtatctgacccaatacagagctagccccaagatgcagtgtccttgagagcatccactggggaagggcagatttgtagcctgttgggcctggacatttgtatgattggccagaaagggcccagaacagactgccattgtttctctaccaaagacaggatgaagtactgactgggtagagttgtttctcactcctgcttatcccagggagagagtggtggctgggaagtggggaaaagtacaaaggggcaatatcttggtttaggttctcccaaaagcagacactgaggtaagatttgggggcaggtggtttgtttgggagatgatcctgggaagtacagggaatgaggggatggggaaggtggagtgtgtcatcagtgagtgtgtcattgaccgggtagcactttgggcaactggggctcagttctgctggggaccctctgaacatatgtttgacatatatcataaatgctcaccaagggacaaagaagctgaggcattttccactagctcctgcctctcattgattgagacacattcctctttatcttaaccctctggcatctcttgtattcctgggctatcacacacattggctgagcatgttattcaggaagtgcgtagctatatgtagaaagatacaggtgcttgaggaggaaccttcttaatggatgagaatggtccactgcagctgtaggatctttgcggccaaggggatgtgggaggtgcctgacagtatgtgccacagacacaccaagcatcagtctcagggcaggttttccttgcagccatctttgatttttaactcttcctcacaggttccctgcaatcttgaatcctttctcttctttgaacagtatcttgaattttcacagaggagcagcagtatgaaaataaaaacacttctgagtgcttactaaatgcagttgatctcattcattctttacaatgaagaatgtagatgaagccactgttatctgtgttttgcagatgaggaacctgagaacacaagaacatgcagggtagagaatgagagatctggaagtcaagccagtttgtctgactccaaagtgcatgatttggttctgagtagaatgattctgagcatgggatcttgggatagatttcctggaatggtatcttggcttcattcctattagttttgtgagcttaaataaagaacttaacctctctgatcaccagtttcttcatctgctgtggggataacaaaacctgctgctccacaggcaatagtgaggattaaatgacatcatggacttggttattacatagtaattttagttaaaattcatgtatgtatcatcaccgttacccatcactgaacttcatggctgctgtactgtgcctcacctgtttgctctgattcatcccttatccttccttgctcctttctgtgtcatagggaggctgacacctgcagctgccttttccagactcccacatttacgggtttctggctgggcttagccaataggaggtgctgatgggaaattagagggttggaggaagagagaggccagggtacttctccccctctgcatcttaaggtggtagcagctatgcttctttgatggctcctgttgttatgggacactttctatgcatgagcatggcccctggctcctagtaaccccacctcctccctctgtctctgggtggtagcagcttcctgctattgttaatctctgggtttcctctctgtttggtttctcagtcctttcatcaccattacagccaatttcctgggataaaccctctttgcttgtggcttattttccttttttagattctgataaaagcacttttaatatgatagtgtcatttccatgtctgaaataattttacagttctgctgctgagatccttgtgctagacacacaaactttggacaaggcagggatgggaagaaataggatcaaggtgattgaagaaaagaagtcctaacaattatggagaatctgttacatattgtactgtttacaccttatttcaggcttggcttatttcatctttacactgtaaaactatacaactggcattactgcacccattttatggatagacaaaataagatgctcaagaaagattaaagagccatgttagcagtaggtctttgctggaggtgataccaagggaattccaatgatactcatctaaattcaaagacactccctactacctctcaaggagaggagaccttcctctccaccagcattcacaatgacaaaaaaaaaagaaagaaaagtttctgactctggttagatcaacaatagctgatgggtaattaggctgaaaaaaattgctggcacctcccaaattgacctggtgataaggacgaaagcacggcagtacttgggagtacagccctgaaaggttaatgccacactctgacatgtggatgttgttctcctggccagatattcacatgggtggcaaactcccattggtgcacccaggatttgacagagatgtactcacacttaaacaatatgtgacctaagtggacaccctactggatgtcagcagaggggcagctggctcactatgggttccagcatagagaaagagggttggcctattcccagggcagtggtttgagaatgtggtggctgtagaacatgtgtcaaatccggaggtggagtctttatccctccccttgaatgtggactggctttagtcattcacttataatgaacagcatcctacggaattgatgctctgggcttccaagcctgggtcataaaagatatacagctttgggtgggcatggtggctcacacttgtaatcccagtactttaggaggctggggcaggcagatcacgaagtcaggagttcgagaccagcctgaccaatattatgaaaccccatctctactaaaaatacaaaaaattagccgagcatggtggtgcacacctgtaatcccagctactcgggaggctgaggcaggagaatcacttgaatctgggaggtggaggttgcagtgagccaagattataccactgcactccagcctgggcaacagagtgagactccatctcaaaaaaaaaaaaaaaaaaaaaaaaaaaaaaaaaaaaaaaagaaagaaagaaaaagatatacagcttccacctggccctctctcaagacacaacccttgatgccttggacctctatgtaagaaatccggctgccctgaagctgccatctaaagggaccttttggggagatcatgtagatatagagatgcccaaggaaccccagctgtcccagagcccagccatttgagtcttcccagtctgggcacctgccatgagtgagtagaccttcagctgtttctagctccctgagagagggcagggactggggcaggaacagtgagaaggagcaacagtgctgagccagccatagaggagcctggggcaaaaggaaacaccagtaatgctgaccctgtctttaaaattttgatgttttgttcacagatgttttgcattagttttgatttttaaaaagtatcagttgaaatattatttatctcaatgactgagtttttttggcatccctttaaaatgtgtgcccaaggtgagtgcctcatttgcctcatcttagtccttgcctgtgagagaccttaagcaagagctgcctggctgatccaagtcggtgcccagaagacacaagggccataatgacattggactgattcattttgcagcaatagctgcatacaaagaataatcatggtcagtttgcctggatttaaatactgactccactaccagttagctggtgtcactggacatgctggctaaccttgccaagcttcaatttcatcatctgcaaaatgggcacaataacagtactctcttcatgggattgttgcgagaatgaaatgtaaatgttccatgcgaagcattaaacacactgccttgcatacagagagtgctcagtaaatgttagctatcattatttttgtttttgctgccattgttacatagcagttggagaacctgggagagctctgcctggataatttcatggggccaatgtccttccattatgctgcattgtaccatcgaggataattgctctctgagctatatttccattaccaggtgccatatcacagcaatgttttatattatatcattttattttatttttgtgaggcagggtctctgctgcccaggctggagtgcagcagtatgaacacagctcactgtagcctccactttctgggcccaagcagtcctcccacctcagcctcccaagtagctgagaccacaggtgtgtgccaccacccttggctaaattttttaattttttgtacagacaaggtctcactatgttgccctggctggtcttgaactcctgggctcaagggatcctctccccttggcctcccaaagtgttgggattacaggcatgaatcatcatgcctggccttactgcagtattttaaacctagattggaaaattagcaattaaaagtgttaaatatagaactatcaaatagatggactaaagacatatcaagctcttggtaagaacaacagtcttggactgacaacctctgagttaaaggacagccgtgttttcagaatgagagcacaactagataattgattggttcatcctcttccctctggctggtgttgcattttggttgtaaatatgcacgaagtgtgtgcatgtgaatgtgggactggagggaaaccatgagtatctaattaggcatgtttatatgtgacctgtgtgcttatgtgtgtgcgtgtgtgtctgtgtgtgtgcatgcatgtgtctgcgtgtctctgtgtttctacatatgggtctgtgtgtatatgtgtgtgtgcctgtgtatatctgtgtgtatgtgtgttgtgtgtctgaaggtaaactccaagaaggcaggggccatgtacttagcatagtcactggtacagaataaacactcactatttgttaaatgaatgaatgaatgtgtatgcgtgtctgtgtgtgtgtgtgtgcatgcatgtccatatgtgagtgcgggtgtttgggtttctgagagtggggttattaatgcttgagtgggtgtgagggtcctacatctgattatgtgtttaggtttctgtaagtctagaacttgaccatgcagagacaatgaattttcttgcactcctctgacccctacctgtgctcccactcatcttccttagggctccccttgcctggggagctaccctcctcaccagcctgtagccagcccccatttggacctttacttctgtgtgtcttccggaggacacagatggcaggagcacggaatcggaagcacttggcaatgaagcagcaattcattccgcaatcccttcgtattcatcgcaacaatgcctgctctgatgggctccgcgcgctgaatgcagctttcaatgtgcaatccagcgggaattgtggtgctttgtggtcctcatcacgtccacttattgtcaagtgttgctgagaattctcccactcgggatgagggaaccacttgttttagcaactgatttccgaaaccttctctgggttggggtatctgcgaagctcctggtgatgtgttattgttcctggtttgtgttttggacactcatgtgctctgctgaagtatgtaaattgccataatgtgaggaaatgtgatataaaaataactccggggcaacaaacaccagaggagctccaagattggcacagcctttcctggtcctgccttggggctagggagcatctcttgccggcagtgttggcagcaaaggcctgagatgccctggaatgaccactgcccatcctcctgcagctgcccagctggcctgctggagaagggcgggtgagacccctcctaggaaggcaggaacagctggatgtggaccgtctccttttttcgcagctggtcaacagaaccacaggctttgctctggctaaagggaatctgccacccctgactattcaggtggctgcacacactcaggggcaaattcacattcattgttggccgcccacagcccgttcatcttgccagcagggggctgtttcccaggatcccaggtcaggtggcttcagctgggatccactgggaagcattgatggggagtggaggacagcggaggggaggatggagacaggaggagctgggaaagtctctgtttccctctcctctctgactcagataatgtcttcaggagcagctggtctcctctgtggatccagaccctaaaggtgacctcctgtggtcttagcttctggcagaagacccttgctcctggtcatcccatctctcctctgaccctctggcctagcggtggtggtgatctcctgctgttgtttatctctgggttgactcactggcccttgtttggcctctcagctcttccattacccatgtgacagattcctggcatcgaagtccctctgttttaagtgttcagtagtttctttttcttgtttagactctgatacttcatcaaggacgtcttggactaccagatcttcctccatggcctgtcgaggaaatgaatcaaaaggcaaaccaggcacaagggaaacaggccatttttctacaaggatggaactgaaggggaattaacagcaataacaaaaatatctaacatttactaagttccacatgttggtcactgtgctcagcactttatacttattatcttatttaatacagtaaccatttgaggtggatattactattattctattctatatgagaaagctgaggcttacagaagtgaggctgatatatctaacagagtgtgcacgcaatggtcaggatttgaatctagcagctttatcccaggactcaggctgcaggacacagtgtgcttctccttttttagtagcacctttcaagctgtagctggtggtgctgtagttccacttgatgttacacaggcaataacaacaaagggttctacagtgcactgaaattggggacatggcatgttctatccccaccctatcttggaggtttgcaatgcatattgacatattaaaggctctgataagtcctgcaggaaagaagcacctctagttcagtgaaccccaagtgttcccctgtggaattctcgtgttactcttgttagcatcctttaggggttggtggtccagggacgtcattttggaaaatagtgccctagagaggggactcatcttgagaatatcatattttatatatatagttgtatttaatattttaagatgaattatctgaaaaatcgactggggacagaggtcttaacattgcagattgagaaaatgccttaggaatgattgcttctaatgcctttcccacttcctgaattattctctcctgtcccatcaaagtgttcgtgggctttgcctggactctcccaggactgaagcatcctccctccaaagccttgcaagctattgttggatgtcttggaggctgaaagacattcaccttcctgtaactctcatccatggactttgcttcttttctcacggggcagttcactgacttttagaatgtattcatcatgtccaccttctgtcttgcattttccagcctaatctgtttctgttccctggtgggtttgcacaccctccagggtgccctcctccttggaggctggtgccctgtgttgaaccagcagaattagggtgtgccagctatatgcagaggtgagaatagaactcctgccttttaaactttctgtatctactaatattaataacattcatattgtaaatgctgtcttctggccaccagatcagagttttcaatgagattgaatctatatagtcagcccaagctttgacatgtcctatatattatttttaatttcacagaagctgctgtttgtgtctccctcatcctatgcttctgcagatgattttgagatcctattgcaggacttagcaaatgtctctatcaaatgttatttcattagtttgacgctttatctctgttttctcttgcatctcattcacatccacagtctacattttcatccacatcgttgataaaaatgttggataggataaagtcaaccatagtgacctgggactcaccaacagaccttgacactggtctactagacaacgacttgcttattaagccctgtcataggcattcccacatttctactttcctttgattaaactgatgctcaggtatgtaaaataaaatgtacaatgagaatgcacttgtggcaggactggtacctaaagcccatgctcagtccaagaaagtttgccattcttcaatagaaatgtgctctgccttccaaccaaggctattgggaaaacatggtctgaaaacgttttgcaggatatggcagagttacccctgggtagtacaatggtggccagggcttcctaagtcacactgggctgtgtaacatgatggtgctcccagcatcctcacatccccatctttgcagatggtgatgacgtggttcccccagcatctccgacacccttcaatgaagcagtcttcattgcctcacagacccgcctgcctgagttttctacctggcctgccccattctcaacaggacagaagagcagagggtcataggtcacaccagcactaggaggttcccatgaacacctcctggatgactcattagcatattaatgcacagcctgtctcctgagaattaaacaaagttaggggtcatttaattggaaatctaaaggacagcacctaccacaatctgtccagaatttatgcacgtctgtcttgatgaacttggagggaatggatgattcacaatgggccacctgccttctgatttataacccatcatttacatgttactaaagtcaattggcacgtgcagaaggtcatcctcaactagaattaggctcactaaatctctgggggcctggtgttctagtcaagttgtgccccaatcatagggcctaggcttctatggccagaggaaatgacgaaagacctgggccaaagagtcttgggaaggacagtgtccaaccccagggagccctggcctcctggtggactgtactactcagtagattgtagactctaggtcattgttaagagcatgagatctagagtgagactgtttactttctagccctctaactttgaggaagccacctaacctttcttagctttggttttttgtctataaatggcaataataaaagtaacaacatcacagggttgtgaaaattaaaatgagctacattaaatatttaggaaagggcctagtatatgaggatgcttgctcagtgttggttatgagattctagtagttgagtggcccatttgtggaatcaagacgacttgtattcaaatcctggttctgttatttaatagctgtatgacccagtgaaatgtacttacagtctctcagtctttatgttttcataagtagtctgaagatgaagtaggtaataatgcacctaattctcagggcggtggtgagtttgagttaaagggggctatttaggtaaaacactcagcagtgtgtttttcaaatagccctgctgctctttaaaggttagcaatgtgaaagaaggttgtggtaagtctcgatttggactaccgcctgtctgaccagatcttgtttcatagtttgtcatgcatgagctgcgagctggcctgttgttctctcctcatgtattttaaatgtatttgtaatattttgttcttaaaaaataataattgtatgtttttatggggcacagtgtgatgttttgatagtgtatatattgtggaatgattgacaacagccacatttctcacctacaggatcaaagattccttgttctttcttgacttgctttcataaatatctatagctcttgttttttttttaaattttattatttttatactttaagttttagggtacaagtacacaacacttgtttttacttcttcaggctttccccattttgcctctccgaaattccctactcagaatctacctttagcccacgaacatatcaactctcctttgactaaataattgggattttttcttcccttgtctactttgaatttgaaacatccaagtgctggcaaatggattctttccatggtagaagcagcactgacattcatagccaggcttcactctcacctgtgttcagggcatggagtctgtgagtttgagtaacagcctgcagcccctgctcatagcacggagatctctgttctattgattgataaccctggtcagagccttagtgaccacctgctctgaccattgggcagcaggaccatggctgaattagcagccatccaaggcacatacagagtggacctactcaggaaacttgtgctgagtggagaaaatgatgaacagagttacaaaaattagagggtatgtttccttcttccttccttctcttaaagagagttaataagtggtgcctttcttgaggtaaaacacatagaatcaacattttccttatcaacatgttattttcaacatttaaagtaatctcagtgggttgatattttttggaaaagttagttgacttatttccagtgaattttcctgagttttcattattaaaaaaacataaactactcgtgatgcattttataatcaattcattgtaatagctaatatgtattgattgccttctctatgtcaaatcccaggcttggtgcttcatgtaccaatcccctgccatcctcccaaaggccctgagacttaggtatttgtattatggtaattgctccagctgtcccaacatacaaactgtgaaatctcagtggcttaatgtgattaagttgtatttctcactcttagtttgatggggttgggtgggctctctgttgcagttacaacatctgcaacgtgtggcccccagggtcactatgataaagggagggaggaaatgagacttttattgggtgtgtttaaaagtcaggcctcgaagcgactgacatcacttccacccatatcccattgaccagaactcagtccatggcccaacccaagtgcaaggggggctgggaaagatacaagactacgtggacatttgatagtcgctagcactattcactacatgtcatttctatttaatcaacaaaaaccagaagttcataaagttaaataaattgctccaagtcatacatagtaagaggaagagccagcaattggaatcagatctcctgacctcgaagcctatgctaccccaacttttgttcaccccatctttcgtgagttctgtcctttagagagaaaagatacatatctttggatgctagagaggtctggatatggggtcagcttcacactccatccatctgcagccgaggggagctgagagaagggataaggtccattccttatttaaatgctatgcaatccaaggcaagcagcttaactactccaaggctcgatttcctatctacaaagggtaggaactaatcatactgccacagacagaattctaagatggcatccaagatttatgtttgctgttgaacattcccgatataatctccttcccatgagtgtgggcaggatccatgaatgtgatggagttatgctacattatatggcaaaggagattttatagataaaactatggtccctgatcatttttgactctgagttaataaaaaaagattatcctgggtggtcctgacctaatcaggtgagtccttaaaaataataagaaaatgcagtagatgctcttttgctggcctagaaaaaagcgaaaagccatgttataaattgcctgtgaaggtcacattgctaggacctgagggtagctcctaaaagctaaaagggaccctagctgacagccaacaagaaaacatgatctcaggcatactaaaagaaactggatgctataaacaacttgaatgagtttggaagaggaccctgagctgcagatgagaccacagcctagctaacctgtgcctggacttctgatccacagaactcctaaagtaaatttatgttgttttaagctgccaaatttgtgctaattgactatgtagcaatagaaaccaacacacatacccatcttggagtgttgttgggagggttaattaagacaacacatgctacctctcctaatacaaggcttggcacattgtaggcatcaaaaatagcctgatgaactgagtcaaatttcccaggatttaaggtgtccagaagtttgactcttgcttctctgaggacagttcttcctttggctatggttggtatgaggggaacttgcacattcactatcttaggtcaagttccctagaagcagagcctgtgcatgtgatgagttgagggagggccttccagaagaactcatgatgaggtgagagaagcaggatgggctggggaagaagctagatcaagttgtgtgtttagctggagactagcctcagcctgagcacatggggagcccgggaccatgaatggcaccacaggctttgcctacctcagggcatggggttgggctcttgtattccaccatcaatcagttatgggctggggacctcccctagtgggtgaaggagggagctaactcccaagcatttccagggcgataagtagtgcccacccaggacaattctccaaagaatggggcagctatgagctgcttgcggtgaggcagtacctggtaaaggggatctgagtggggcaccgactgtatttgctacattctccttttctgctggtcaatgtgttgatctctcaggttctattctcagtcctttacctacctttcagcctcatagacttgaagatcccggttcaagccttttctgtgattatttggatctttcaagggtctccacagactctcatctccatcgttacacacagactccagccagctcagctctgatgtcatgcccacgccacctccagtaccccagcaccctgggtgccggctcctttaagccatgctgctagattaagtacttaaatatttgtggcccctgttatgtgccaggtactgtgctgggggtgggtgggaggaaataagggtatattaagaagaagacctttcccagagtttacattctagtaagaaagagactcatgaaagaatcaattatacaactgtggatggcgtgtagtggacacctcttgtgcctagtgtcctagcaatcttctcactgccaccctatacccccagtgcctttcactccatccattggtatgtaccagctgtgtgcaggtgtagcatgatagccccttgtctcagctgagcctcttgctgtctaccatgagtctttcctcctgtcactgctgcatgggagacctgcatgaagcctctcaataatttggacgcttgggaatttttggaagagcagaaatttaacactccatgaagcacttttggccaccaggggaccggggccctcattttcataccttgggtggaaattttgaaaagccttctctatagctacttagggcatctctgcaggattgagtcccagttgctcatagctcggtaacatattattgaatgggctttaccctcttcttgtttcattcttcccagtaccttctaccactccttgagatcacctcccaaataagctacctgcactcaagcctctgtctcaggcattgccttcaggggtaactcaggatatggcaggagctcttagggcacctaacatgccacctgccatgagcccaacggtagatagaaaggatttttctttaaaatcaatacaaaatattttacatatttatggggtacgtgtgagtatttgttacatgcacaaaatgtgtaatgatcaagtcagggtatttgagttatccatcaccttgagtatttattgtttccatgtgttggggacatttcaagtcctctcttatagctactttgaattatacaatacattgaggctaactatagtcacccagtctgctacagaatagtgggcttatttcttctaactgtatgtttgtacctattattgaacccctctttagccctaccttacaccacacacttcccggtcactgatatctatcattccactatctatcttcatgaggtcaagttttgtgtgtgtgtgtgtgtgtgtgtgtgtgtgtttgttgttgtggtttgttttttttttttttttttttttttttttgagatgaagtcttgctcttgtcccccaggctggagtacaatggtgtgatctcggctcactgcaacctctgcctcccaggttcaagcgattctcctgcctcagcctcccgtgtagctgggattataggcgcctgccaccaagcctggctaatttttgtatttttagtagagacggggtttcactatgttggccaggctggtctcaaactcctgacctcaggtgatccacctgccttggccttccaaagtgctgggattacaggcgtgagccaccgcacctggccatgagatcaagttttttttaactcccacatataaatgagaacagatggtatttgtctatctgtgtctggctaatttcatgaaacataatgacctccagttccatccacgttgctgcaaatgacatgattttattcttttatgtggccaaatagtattccattgtgcatatgtgacacattttctttatcccttcttccaaggatggacacttaggttgattccatatctttgctattatgaataatgctgcaataacatgggaatgcaagtatccatttgatacaccaatttcttttccttggtataaataccaaatagggaattgctggaacacatggtagttctatttttaattttcttgagaaatctccatactgtttttcatagtgggtgtacacatttacaggccacctaactaaactattaaccaagctgagaactgagagctggcataaagcggtgaatgggacagcgttctaggttgaggatcccttggctccttctgcacctggtgatctatttgttcctttgcgacctaatattatctgttccttacaggatccttggatgtaacagacatttggtcttctattatgacactttccaaaatatattgcagcagttctgaaaccttagtgtacataagaaccatctggagaattaattaaaaggattttcggctcctctattggatatctatcgctgcttagcaaattatccccaaatttagtagcttaaaacaacacacacgtattatcttacagtttttgtgtaacaggaagcaaagcatgacttcacggtctcaggatctctcacaaggctttagtcaaggtgttggctgtggctggggtctcatctgaagactcgattggggaaggatctgtttctaagcttattcatgtggttaatggcaggattcacagttcttcaccacatgggcctctctatagggcaatgcaacatcttgtttcatcagaacagagatgcaagaacagacagtgaggtggaagagtaagatgaaagtcagtcctttgtaacctaatcataggagtgtcatctcctcacttttgctgtattctatttgtcagaagcaagtttctaggtcctgcccatacttaagaggaggagattgaattctaggccaggatcactgggagtcattttagaaggcagccttccataggccccacttgtaaagccgcagattcaggaagtctggaataaggcccaagaatctgcactttttagtaaacacactagattggtggttattaagctctgttgcatattagaattacttagggactgggcacagtggcttatgcctgtaatcccagcactttgagaggctgaggtgggcggatcacctgaggtcaggcgttcaagaacagcctggacaaaatggtgaaaccccatctctactaaaaatacaaaaattagccaggtatggtagcacacgcctgtagtcccagctacttcagaggctgaagcaggagaatcgcttgagcccgggaggcggaggttgcagtgagccaagattgcgccactgcactccagctgggcaacagagcaaaactctgtctaaaaaaaaaaaaaaaaaaaaaaaaaaaaaacttagggaacttagaaacatccagtgcctcagctgtacccagaccaattaaatcagagtctctggtggggtgagtgcggtgtgtggagtctggatatccatactttttaaaggtctctacatgattctaatgtgcagctaagtttgagagttctggtggtctgttacattgctagcactcaataaactatgcgtcctggtattcatgtcctttcttttaatcagggctgggctgtgacttgctttggtccattgagtgcagtagaagtgacactgtgcctaagtcttaagaagtgcctggcaccttccacttttggactcttgggagctctgagaccccatgtaagaactcctacatcctctagagagagactggaaaagaccatgtggagagggagagcctgcaactgtatggttgttgttcaagccattacgttttgagggtgatttttcagcaatttctgtttcagttacctattttacttattcttccaactctaccatctggctggacttggtgaagcagtttttgaaggtggtcacttgtgtggctacattcagcaggggggatgtttggggctggctcagctgggatgctgggacagctgggcctggctttctctccatgtggtctcagagctctctgagtgcagaagcagaagctgtttggtctcatgaagacctgaaaccagcactgtatcacttttcatggaaggtggcttgctgggggccccaacacacagataccacaaaaatcagtgcttctcaaactttcatgtgaaacagatcccctggggactaggttaaaaagaggaatctgattaggtaggtctggggtggggccagagaacctgcatttctaatgagttcctgagtgatgctaatgctgctggttcatgggccacattttgagaatcaagaggctagaagatttcgttattggtgccccttgagagatacagagttctattgtaattatcttttcatacgtttattattgatccagggatgcttaaacatctttagtttatggaccccctagacacagggagtattgcagtaagtttagagtttacagacttaccccatcacctgccaggaagccttctatgaacccctgcaagtaaagaatccctaccctggactgggaactcctagatctgtgttattatttggccatgacaaacagtaggagcttaatatatgtttgctaaaaataaatggatgaatgattggctatagatatggtatatggtgtatatgatataattatatatacataatttatctcaatttgacttagaagggccttactgctaactaaccaccggagcaaattggcctaaaccctctcatgtccctgacaaactgtcagtgaaggtagggtgatcaactgtccagtttgcctgggactaagggcttttctggacataggacatttagtgctaaatctgagacagtcccaggtaaaccaggatgagttcaccctgaatgaaggtgaaggtaaaggtactctgagctcccctaagagccaggcatcagagacactgactcttgccctcatggctggcattttctgccacatcagcactgttcgtacatttcaaaagcccatctgtgcccgcaaaggagtgacttcctgtgtgcatgggcggccctgggaggctgggtctctgagagcccgttttggattataagcctttgaagacatctgcagggaagggataattcattccagaaaaacagctctctttgccatgcaaaccagagaccaggaatggaaatgaggtttttaatcacatggggcattttcagagccacctgctggctctggcatctagctgagttgcttcatgtagaggtgctgggagcgggtctggcctctgaggtcgggctgctgggaggcctcctgggtcaaggcatgagctgctgccttcaaagtcctcttgcagctgcatccagctgggcctgcagggaactgatgccaggaaaggtccgctctgagcttagcaatgatgccctcctgctgctcggaaagtcctggacgcaggacctgtcttatattttgtctctcaatgttcatgagctcctgttctatgccggtctcctcagccctgggctgggggagcaatcggaggctgaacactgtcaattgaggggcttaccagaagcacctgctcccacctcctttcctggcagactcactcatgctgtacatttgttagatctaggttgaaatctcagttcccctgtttcttgggttaggttccccagaaggagatgcttgttcgggatcaacacttgtgaaaggcaggaggaatagcaggtttgggcagaaggaaaagtcaaattgtgatacaggtccaacaaagcctgggccaaccagaagaaagccctgggatgaatatcaatcatcagagtcatcctagggtaagctcctaaggctgggcttttacaattttgctttgctctgttattggcttctctataaaggacatgacttcaggggaggtgaccctcagaagctgagacagaggctgaaggaggtcattgctgaagtctgtttcttgattgagcctcctgcagataggtataagcaattaactgaaaggagttctgtgcagcacactttggtatctactataccttgcttataaactgtttgattttaggaatgtaatttacttttctgagcctcagttttcatgtgcataattggggctactagctataaataactaataactttttttaaagaaacttcattctaataaaatatttcaaacatacaaaacttatacaaaagaaatgagtttagaatcgtgaacttccatgtaccagtcacccagcttcaacaattaccaactcatggtcgcttttgttccaactataccccaccataactactggattgttaggaagcaaatatcagattcagaaatattgtatttcatccaatagtatttcaaatgcatctctagaagggcttaaaaataaccaaacataaccacaatatgcctaactgtttttggcagattaaatgatctagtttaaatggagcatatatgacagcatttggcacacaacagggatttagaaatgtcagctatgtcaaaacacatcctcttgggaaatgacacatgaaagaagggggaaagaagcttaattttatggagtgtagagtgtcaaatatgtggcacagacactaccttcttccacccttttccctcaacagacatcactattcaatcatggagctactctgctgcacagtgttccaggcagccactgtccattcagtggcagagattaaaagatgaaatcagtttattcacattgtcctagcagactgatgaacagttctcatctggaacaatggcttaacacagagccaggcttgctgccctgcagaatatctgacaactaccatccagctgcatggttctgagtccgggctgggtcactgtgatgtacaccagctgctcatagaccacttttgccatttccagtgtagggagggagactatgcagctttcacccagggaaaattggtgagaagaagcagacctcagacccttgagagccgttcaagcctgacatttcaacatctgcccctagagcactgtcttctcattcttgctttcttctacttcagtgtctgccagctactttttggggttccttccccaggcagttatatgcttcttcttcatctcctccagccttcctcactttgttacaccctctctgaataatgttgtcatgtctccagtggacaaaagtgttgggggaaaaggagtgtatgtgtgggtgtgtgaaataacccttaatacatgtacatgattccatagtgtaccctgtactctctgttagttgtcatcattcttatgtaacactgaaacccaaaggaactcatcatattttcttctatgttaaacttcttagatcaccaggtcaaagggacagattgggtgtcctgactctgactcacattgatgcatcacagtcctggaaaatccttgagctgtggaactctttctttaaatgtaactttatgttattgtccactgtccaacattgtgggtgaattgaggtgggggaacatggtgtactgtctaccattaaagtgtggtagggaaaaagagaaggttggtttgtggaatcactaggactttggggagcccaatttaaacaccatcacattctacaagcagacacagggtataattttactagcctggagtataattctgctcttgacagaatgtctgggaatcactggttatgagattctgtattttcaaacccgcatttataccctataaaaatgtggggtttactacgtgctggaagcagctattaggataaattgtgctagctcctgaaaccaggcataagccattcctacacctgccaggactgtcctgtcttcatcatacctagcttaagccaatacaagaatgaagggaggaggaatctgagccttggttggccctaagccttcacccaaatgatcctgaaaataattgtagtgatagtaacaacagcaaatcttgaatatttgctctctctgtgttaagcacaatgctaaacacacatacaatttaatgcccaaaactctaggtaagtatttttatcttgtctttagaaactcagggatgctcagggctaacaggtgacaagtgattaaggcaggggttcagatcgaggtctccccaattctagttctcacattgtcacttgtccatcctgattccttagcctgatgcttccatgtaatcttatgatggtcttcaggaagggtgtctttccttccttgtgctcaaggtcacccacctaggaagggaacatgcatgaacacaggtgcatctgagtccaaattatgagctttgctgctttttgagaggcgggtagtacaatgggcaggatgtattgcttctgagaaaaattacctttatgtgggggctctggttcataccccaaaggcaggtaagaacagactgcttctagaagcagaagtaacctgtatcctgccatttttatttatgggaaaatagttttatttatttagtaaaaatatgcaggatgaacaaaattttgtttctatgtttttgtagactaacaatatgaatagtcctctgacaagactggacacgggaaaaagaaggtagaaataaaaattttttcctaccgctaaagaagagaatctcaattatgaaaaagatggcaaaatgtgggaatgaatgggagctcatgaggccagggaggagacaatacagtggataagtaggtgcattatctcagattgcatgcctgttacaaagacttggttcataaagtgatgaacatcagtcaccccagagattttcagtttatcccagcccagcacattcgttaatgtatagtgtctagaatatattaaatgcttgtacatatcaggcccatgctaggaactttgtatccattactttaaaaaatacctttttattttggagcaattttagagttacagaaaacttgcaaagatagtacagagagttcttgtatgaactttgtccaggttcccttagtgttaacatcttacataacccaggtatatttgtctaaactaaggaattaatgaaggtacactattattaagtaaactttagattttttttggatttcatcagcttccccgctaatgtcctctgttttcttgttctgggatctaatccaggataccacattgcctttagttgtcatatctccttagtctcctttggtctcattatttttttaaatcctcaaataattgttcctttttagagatgagaaacaggctcaaacatattaagtgattttcattggttcacaaatctagtcagttgctcagctgggatttactcagctctgtctgattgcaaagaccatgcatgcattttctaaccactgtttactatgctgccgcatgagctgcctatatgagaatcctgaacaaccaagaaatgaggaaactaagagtaccctgagttttggttagtttagagcaattgccacctagagggtgaatgaatcctaagttcacatttccagcccagacttttgctttacaccccggagcatagatggagatggggtgagaagctgcacattggcccaattggccaagtttacccatttggccaagtttacccatttcgctatcttttgaatgccccataagcatctcaaactcagcatgtctgaaaccagattcgcctttcttctcaaatctggtattctggttctttccttcccaaacttggctcatgatgatgtaaaaatggagaaatggctataagcagtcaccagaacttaaagtcatgcggagtaattccagagcagagagagcacatgttgagtggagagagagaatcagtgacttcttagtgaggggggaataaattagacatgtgatgactggttgaagcgtgctcagtggctaggagtagtccctgaggaggaggcaattcccaatcttcttgctgccctgagttccctcttaacttcaatttctgtatctgcaagactgcccaactctactatagttgctgttgtccccgagcacaggttcttgagttttccttagctcacttaccatacatctctattacttagaaaatatctagatagactgagactctcagttctgattacccaaaaaacccaaaccaaatcttccttcccccacagagctgcagaagtggtgtggctccagcttctctagaggatgcacagagggtcttagtccagaattccactgaatctgtctacttgatcctacctccctgcaccctctcaggatggagaagtggaaagcacaagatacacctgggtttgaagcctagagctgccatatcctagtcatatggccttaaacaagtttcttattctcctatggtatcagtttttctctttatagaatgtggataacgatatcttgcttagcattgacttgagaatttaagacaatgggtaggtggcaactgagagaaagactttcttcctctctctttctcatctgtcttttccatactttttgaaaatcttatattcttagtgtgaaatctttcccctgcttctctttctgcttcccacatgaggactgttagatttgatgaattcttgaataattcattcataagcaaccaaactctttgataaacagcttgggattgagggaagctactgggggaacacatgcaccaagaacaacagttttattttggtccctgctaaggtgagtgagggacacaaactgaaagctgggatgagattgcacagcatcatagagtggctttggagaggctatggccatggataggcagagagagaagagagaagaggcaactggcaggagaaaggaacaaggtacagtggaactgggacagtgggcagaagaacaggggatttattcaagtttctccggtctggtgagcaatgtgaagctttcttttcatttccttaggacatctttagtacaataccatttttgcactaacatctgtgtatctgaatccttgaaggggtatctgataaagtgctaagtgtaacttcaaggtgagatggggtgaaaaccaagggcaccctaagaaggcccatcatgtctggatttcattccagtgcttggcatggagtaagtgctcagtaaatactagtgttaatagtggctacagttgtaatttctttccagctcctttttctcttctacactaagatcttcaagagctcaggaaaatgcacctgttttattcacttctggattcttaccattggcagagtgcctggcccatagttgggttccaataaatatttgtttttatgactaacaaatccatgtaatctctgtgaccagctaagttctcttctcagctttattgtgttttcattcaatactccccatcctcagaaagctgattcattctgggacttcagctcttacatccatctagtggattactaaatttgtatatccattcccggctcacatggataaggctggcttacatggataaatactggaattgacagtatttgattatttttaacttacaaaaacaacaatttcataaattgtaatctaatattcccttaaacttccactcaaatgttatattgtcaccttcaacacaacataggtgttgtgcacttctctgcctattgactgttcctcttcctggcattgtttaatcggaaaatgcttttagaatagaaagctatcactctgtccagtagtatctttttatcattgagatgaaagactgaggttacattctgcctctgctacattcaagtcacttgcctcaagatcacacagcagaatggtagcagaggcagaatgtaacctcagtcttctgtctcctgttctggttctaggtctatcaagtgcatggattctccagcttcccaagtcttgcatctccatcttcctccttcccctcatcttctggcaatattcagttacccaccaagtccaggaacttcttccttcaaaatatgtcgtgttcatatatatgtttcccaactcaaggacctatggctgccatgttagttcaggccaacctcatctcccacttgaatccccgcagaagttcattgttaaacctctctcctgctttcttacataatacctgcctaaaggtatatatgaaagctaaagtttcaaaagtcaccaaatagcttttaaagtctaagggctgtttggtcccagagagaaaaatgattttaaaaaattaaaatagtaccatatcatttagacataatgttttgattacatatgttctatgattttataattttttgttcaataatttcagacttacagaaaaaatgtaaaaatgatacaaaaattgcctgtatgcctttactcaaactccccaaatgttagcatttctaatgtttaccattttctctctctttatacatttttattattattttttcaaaccatttttgtgagtaagatgtgaacatgatgtcccttggtcctaaatatactagtgtggattttctgaaaacaaggactttcttttacataatcacagaaacattatcaaaatctggatattagcactaataaatacaattgaacaatctacagactttatttaaatttaatcagtggtcactttaaaatcctttctagcaaaaaaagtttctgatttctgatccaaaaaaggataacttgttgcaatttgttgtcatgttctgtagtctcctttagtcaggaatagtaattcagtctttctttgtctttaattgaccttgacatttctgaagagaggccatttattttgtaggctgttcttctatttatgtgtatcccatggtgcctcgtgattatttgtgtctttaacttttatgtctctttaatttttaaatgagttaatatttgtaaattgctttaagcagtgcctggcacatagctctatataaatatttgttaaatacgctttgatccttttcttcacagccaaatatacagttgaccaatctatggccaatgagtacttgaaatggaagatttgtcatttgggggaatttctaagtattttcatctttgtttcaactgctttacctgtctgaaaactatgtttcttatagctaatatcagcatttacatttgtacccctttctgtacttaataacataataaaaacaaaaccaaatctaccattaggtcatcccacagaccctggcctgtggatagagatatcattgctgcccaagttgagttcttggctgctaggcagggtcacctggtccttgggtgctcaagaatcaaaacctgggctatgcgtgtgcagcataatggactaaaaatgtgagctatccaaatattttaagaataaaagtggaagacttttctgcaaattatggcggcattggtatggtattctatgaggtatttaatttaatgttcattgcagaatgggatttcactcaatattttttgtttgttgaattacttattgcttccttcctggcacaaaccttgtgggtcagcagactggactccttgtgtcctactgggaatgtgatgcatcacatccctgcttctgggcttttgcttctatggctccatctggatggcccttctcacatttccacctgctctcctgctcaggcctcttaagctcgacatagccccacctctcccgggccctccctccacatctgtctcttccttctcagtcccctgcagcatctctgctctgtatcacccagtctggcactaaacaagagatagatttgattctgaattagctgttccctacctcaagccccattcccccaaatgggctaggaagtctttgaagtaggtataattggaggtagatttaggtttttaaaaagttgaatttccttgacaatttaaatttgagaaaattatatttgaagatggagcatgaataaggtcgtatatttcttatcacctcaaacatggatcctatatgagctagcatttatctaaagattatttccaatgacttgccaattattgtgctattttacatgtattatttcctttaatctttataggaactctatgatgaggtggctacaggctactgttaatattaccattttatttagtagaaagctggggctcagagaggttaagcaacttgcccagggctatatagtgatcaaatactagaatcagaattttatttcaatccacctaacttcacagcttatgcctgagccactatattattctccctccatcatcagcaaagggaaaaaatagcattactgatgaaaacagaggaaaatggtggctttatttagaatgaactaacatttgttgattatctactgggtgctgggcactgttagacactttcacacatattacctcagacaaacttgagcaacgaccctggaaaggaagcaggtactcttatctctatttcataaatgagaaaattgagaaacagagaggtcaaatgacttactcaaggatacagagctcagaggtgatatgtatttctggtacatttagcttcatccggtaacacacagccccaacccttttcacttgtcttacagtagtgcctctcttctcaaatagaatttaactccacagcataattattcttgctctgaatccccactgtctcatggcgtcttttagcatcagtgtcttctagaagagcctccaaggaaaggctgctgggcaaggcactgagtgaagcaaggggggtgtatattcctgccctgccttctcctccggctgatgaagcccacagttaagatggtctaccggggctcgctccagtcttcccagagagtaatgttctgctcaggggtgatagaaagctctgtggctggcccagccgaggtattggagaaagatccatcacccctgagtgatcggtgacccacaggtactgcgcatggaacctaatgaccagtcactcaattaccggctcagtgacatgtttgtaagggtgaactttagagtgctactagggagcggacagatgaactatagctgtgcctgcagggcagagctcacccagcccaactgcctctgcggacccattacccagtaattagggggatttttaagtaggaagcaaggagttaaattatcacttagattactgcttcacttgtcacagtagaaagtgctgctttggggaaagaaggaaggattggggaaagcaagagagggagagacggagaaagagagtaatggaaggagtgtgagagagaaggctctgggaaatcgaggtttgagataagggctccattcattttctccactggcaactgtaacaggaaggtgccaagggtgaccaatgagagatgcaggtaagttgagagtctgagccacagctgaggtttgcgtaagtctctacccacagcatctgtttaggccatggtagctcatcaggaagatgaaggtaataatacaatcatagttagcaatgattgattgtatatgagccaggaacttggctaagcattgtccttgcatctgctcatctgatcccttccaccctgaaccagggggctgccactgtgatctccgctcaccagatgagaacactggagcaccttgactatgtaacctgcaacagagctggagtgacctgctcaatgccggggcccagcctcttaaacccctcaccaagcacctctgtgaggtctttacagtcctgaaacagccccaaacctgcctcttctgcagaggcaggggatgttctcagtttgctccagacttccctgtgttgagcttagctctacgtcttatttcctttgcagcaaaattggcaactgctattaatttttactgtgtgtgtgtttaattttttttaatgaaaaatattaaacaaagatcaggtagacagaattgtataacagacatttatgcactcatgacctggcttaaaaaattgttaactactgatcaaacttatttttctgtatcccccatccaattccttctaccttcctgtattatttcgaagcaaacctcaggtatcaaataatttcacctctgaatctttcagcatcaaatataaagatttttttaagaaatcaaaatacttttatcatgccctgaaataataattattatccaatctgttcaaatttttaaattttattggataattttagaaatatagacagttataatggttcaacttaccattttttgactacattggtactcaaccattctatttttcgtggtcagtacagtattcaatacattacatgaggtagtcaataccttattataaaataggctttgtgttaaatgattttgcccaactttaggctaatgtcagtgttcctagcatgtttaaggtaagctaggctaagctctgatgtttagtaggttaagagtactaaatgcatttttgacttaatgatattttcagtttatgatggatttattgggatgtaatcccatcacaagtggaggaacatctataatttatttgtttaaattaggatccaaataaggtcggtacattgcagttggtcggtacattgcagttggttgataggtgttttaagtctcttttattcttttttccttgatatttatttattgaacaaactgtgttatcttaaagaatttcctacagtctgcattttgatgattggatcttagtggtatggtatggtttatcatgttcctgtgtccctggtgttttctataaattaatggttacatctagagttttgatcaggttcaggtttggttttttggcaagaatacttcatgtatggtactgtggacttctactaggaagtctggttttctttctttctgaagttagcaaccactgaagattgctttaatctggtagtttttaattacttcattcttttttcatttattatctgaattacattttaaagaaatcttattagctatttgtgatcctgagaaatagtttatataggagaagcaagttaatgcttactttcttccctttattttctagtttttcaaataatgagttggttctctagtattctacataggatgcgaatgagcttattttattttattattactattattttgtacccatagactttttaagttcttggtaaatttcaatccattacagttattgttctttttgagatccaaattctcctgtgtctggccattgggagactttaagttgactcctgagtttttcaaacatgatcacatggtttttagtagcttcctgctgtctggtttgacagtaggttccagactcatctcctacactttctttttcaaacctagtctcaggcttttgtcagttaagaatgacatttagatagcacaattttcattttggagtactcatggctactaggtttgtcattgtctctagggcttttttgtggataccggtacaaaatatgtatcttgtttaaaagagaaaacaaaccttgagtttatattgatactctcaattcgtttttacttactttctttgatcattcatctgtatttcttgtttctcctgttgagtatcccagttcccaaaggtaaccacatttgttctatgccaccatgcacactcaattgtctcagaggagcaataccagcactaccactaaggtatgattagtaaaaacaacttaagggtttttatttttccttaattcatttaggctggggatgtcctgccagattcctgtatcttaaaatcacttgacatagttttatctgtatggttgtaccctcaacttcatgtatagatttattcatgtattccattttactttaattttataacaattgccttttaagctgtatttattaaattactatttcacatgtcaataatacacattcattgaaaaacataattatatatatatttttataatgaagtaaaatgcatatgtgattccacagtcaaacctacagagcagctccttctacactgattcacagagctcctcagcagtattaagctccgagtaccacatggaaattgacttgaaaacacacacttaatggctgctttttcttctcccatcttactttctcacagccttatcaattttcagggatcacatcaaataaactacttttatacaactctttgtctttagtcagcatctaaagtaactcaaatcaagacacacatttttctctatcttgcttttcatataagaaaatatcctgaattttcacttgatttcatttcacagtgaaatgatcacttcatcgttctggagataaccatggctgctttcacggaggctcctccaaaccctagtgccttgctggaagggcctggaggagctggattgagcaggcacgttggagggagatcccacctgagttcagactgtggacactgctgaagttctgggtcagagcacacatctattccttgagaagtagggcagtggctaagagatttgattttgatgccagagtaactggagctgaagtcctggcttggcaggtatagttgtgtgacctgagcaagtcacttcccatctctgagccttggtttcttcttttgttcaataagcataataatggcgcctgtcctataaggtacattggtgaggcacaataaataaagtgtttagcacatgaaacactttctagagatatctgtaatcaccatcacctctaaaataatgagactgctctagttcctttctgagtgcagactgtctttttttaagttttattttattaagtgataaataataattgcatgtatttatgaggaacaaagtgatatttctgtacatgtatacattgtggaatgatcaaattagagaaagagtagttagcatatccatcacttcatatctttatcatttctttgtcttgagaacatttaaaatcctctcttttagctattttgaaatatgcaatacattattattaagtattttccaggcttggagtccttggttcttttaggaagtcctcataggatatgattccaagaccctctccgccctgggttgcagcaagtccagacgtggctgtaaatcagatatggatacattcttgatttctattcaagaaatagacaccatcctcccagtgtgacatatctgccagagaactcaaagaactcctaatgaaattttctcattaggaatttctgtgaacttctctcatcttgaatttccctgggtgttctctgccccatggcctggcctttccccatacggatcagggaccttccatctgcttaggccctctttagccctctcctaggaccccatccttctttccaacaacacaggtatatcctgggggtcccaacaagatatttttatgattagagaagtctaggtatttcctgataattgatcatttgtggtgtaaaagtgttttaactctttactctgaaaagaacgtctgtcctgaggataggtaataaaaggaaagtatggcatgaccctcttctcgccaaggaagcaaacctggaagatggttggaggaaagcaaaggagaatatttacaaataaggaaaagtagaatggagtttccttgtctacttagtcagtctgtcttgcagatattttgaaagaggcaccccttagtaggctctatagccatctgtgggtcagaggtctcagaggaaggaaggggtggctcaaatacaaaatggtacccctaagggccgcgcaggtcccccaatcccaaacaatactcccatgtgccagaggtgaaagtgatgatccactgagctgaagattacctagagttttgctaaaattctgagcaggaggttgataaattatcccagggaactaagggttgtgtgatatgaaacagatgcatagatattcctggcagttttagaagaagggtctagtcctcagagagatggcagtgactaggtgggactatgggatacatgtattttattagatttaaagtatttttggatagtgggatacaacacagagccactcagatagatggagaaacagaactctttgttacttacagctccaagtgagtgacaaaaagaaggctgccatgcagggccatatggggttgcagtggggatatggtaacagcaagctggagcaataggaggtggcaagtggcatggaggtagctaggtttcaatagctaatgtgaacaattatgtgggctcctgggtttagggtttatttgtttggtacttggccctggaaaatggggacctgataagggaagttcttggggtgcttgcatagtggcccaagggagtggaagccagataaagaaggtgattggcttagcaaactgcccatgaagggaaattgagaatttttagccataatttcaaaactgggtcaaggcagcacttgtgaaatgtcaccctacagcatgtcaatggggttcagggcagatcctcagccttggagaaatttaagttaaagttgggctagaacccaggcataaggcttggaccaaatttcaggaatcaaaacagggaaaccaaatgagtgacatgcatgccattaccatcctttgccttgatcatggcagacattgccaaccaaacacaattctcctccttactgagcctggactcagccttgaatccttctcagctaccatccctgacaagcaacaaagttgacatgtaattttcaacccatgactacacttcattagaagagagaattagttaaggggcatgtggctatctgggtttcctgtaatttgaaatctatggatagcaaatataattccagatcccacccactggttggactaagtgtttctcttcttagcagcattgttcagggactgagagaggctgagtcataaagggctgggccccgggacagaaagtgacatggagctggagaaggcagagtctaacagtctttcaagcacagcacccaatcaaaaggaatgtacctctagtgcggaaacattggagtagccctaagtaacccattgagaagccagtgttctcaaccatatatagacggaccaagacccagccacaagatatattccagttgtggaatttgggtcagcatgtgaaggtgggatgtgatatttgatcttttttgaaaatatagctacccaacttcaacttctccccaaagctatgctatatctgtatccttttctgaagtattttattaatcatttcatccatatttctcttcacctcagacttcaaattttgatttcctctggtatttatagcaacatctgtggtttctcaaggcgcacaaggcaggttttaggatgaaggtattttcatggaggctggcaagatatctgaggttcaacaacaggcagctgactcaggtaaaatgaagccaaagagaaaccaaaccttgttttcttgattttgtttttcctttcagggagggagagatcactggccaattttaatttaggtttcttctcccttagttatccaaagatgcaatcaataaatacctacttgaaccccctactaggagccagattgtgtactaggtactggggatacagtaagggaaccaaaccagatatggtccccagcctcctggagctctcctgggagaaagagagcttaatctaattaatctcataacaacatgtaaaatcacgtctgatgttttgagagagaggtatatggtattaagaaagcttatgataggggatttaacatagtgagggatggcatccagaagcgaatgataactgaaatgaaagaaggatctgaaggagttggagaaataaaaagagttatgttgtagtaggaagggaattctaggcaggtggcacagcctgtgcaaaagctcagcaactggaaaagaacatgaacgttatgtgacaggaagatagagtggttggaaaagactgaatgagagggacatgatggacaatgagtaggaaggagtgctcagggagtgacagacctgacactgtaaacaattcagacgtggatttactgagaagctaatagcatttaaatttcaagaactctcatttgcattggggctttcaagaacacttgaacaagggcatgaatgttgtcaactcagttttcttttctttcctgttttttttttttttgagacggagtttcactcttgttgccttgttgcccaggctggagtgcagtggcgtgatctcggctcaccacaacctctgcctcccgggttcaaacgattctctgcctcagcctcccaagtagctaggattacaggcatgtgccatcacaccggccaattttgtatttttagtagagacagggtttcttcatgttgatcaggctggtctcgacctcccaacctcaggtgatccacctgccttggcctcccaaaatgctgggattacaggcatgagccactgtacccgaccacaaacagttttaagcttactgattacacaagaaaacttttgaaatgtcctgaaatctcacagctcatctataaaataaactggataggaaatttttaaaatttgtccacaatcctaaaaatttaggtggcgttgccaatattaaagctgcgaagctgaaggataccagttttactccaccacaccagagggaaaatatttcagaaagtctgagttccttttcttttctttctatagaaaatgacattacaagctcattatcatatgaagaggagatcaaagactatgccggcaacaaaatgtaggaaaaattgttatagagttgtatcagtctgctaattaacaaaaatatgctatttttcaggagtttgtaatgttagtggtatctgccactttaacaaattgtagtttatgagttattttcatattctaaatacatattcaagtttgtgtctaattttgaatgcagaattttgtgttcttaactgactgcccactgttagtcattgaccactactatcaatcttccgtcctatttccagggttataattttgaagtataaatcattaccaggtctctccaactcttaaaacccttcccttgtatgagtgggtggtaccaggcccctagagatgatctttctagactcagctctcagcactgggtggattcattcatgttcaggcagagcggtatgattaacagagaggctgggacacagggtgcccttgctcctccctcatccttatcggaggatcttcccaatgtatctggcttcaggccaatattgagggttccacatagaggcagggagagaacactggactgtagatctcagtttgaagtcagcctctctcacatactacgtagtcaagtttctgagtgtgtaaaccagaccaaagactctggaaagatctgcacgtaaacagtgcttgacagaaaggcagcagcagactactaaagatataagattgccttagtagcctcagtagcaagcaaaatggaagatatctgtactgaggcaagaaacgcaaagcaggagatgatctgtaaggctgtcatagggacacacagcttatttttttggtagtggaacattttaaaaacttaatgcataaacatatgaccttttattaaagagaaattttatgtattggtggataaggccaatggttacatgtactggatgctttaaaaattagaaccaattagagtagattctttattctcttggttacattgtgaagtgtcttttatggtcatatgctgtggttggaatgacagtgtgcacatatttcaagaaaattagaagatacacgtgaacaccaaatgttctccccttttttctgcagtagtcttaatgattttctccattatctcataggaggtggagggagattggtggagggattttcagtggtcactgttttcttcacatggtcttgaatgatgtctttatacatgtgttcagctgtgaaaatctgctgttcctcatcatagccaaaaaaccatagttgtgccatctggtaatatttaccatatgtgatgtaaaggtcacaagttttggtttgcaaaagagcatcttcacctccaacatcactttaagctttacaagcttcttctattttcctttcatctagggtagctttatctgcttccagcaacccactctcttcatattattccataaatgtagattttccttcatctttttcttcttcctctcataagactgagcagttttcgagttttataccatttttgcttgtaagtataatctcctcaacctatttgtttattcctgcaattcctgtgctgtgatgtgtatctacccaggccctaccaccatcatcttcagtgatagcttccaattcacctgaatatgccatctgttttgactggatgtagcatgccacatttttggctaccaaaaattatttgcctgttggtagctatgcctctcttttcagttcttcccctgtagcccattgctgtgtcgggcagtggacagctaagtgatctccagctgccataaactcttttggggtggtaacagctgtttccttaaactgattccttgagaattaggtcaggtattcagttacttctaatgcctttccttcaccatattaatcaattctggatggatgctggggctggagtagtggccagccccacaatgggatgggaaaggtacctaagacagaggccagggagtcagtgcccccgtgacatgaatttgcatcacatgacacatcaatatgatgtgaggactctgcagatttttgaggcatcttctgccattctcaggggcaaagagatcatgaaatatacaaaaatgccatcaaacccttaaaccaaagcatcacagttatctgttgtagatgtatggagaagtgaaataccctaaatactgcccaaatcattgaatacaagttttgattcccaggattataggttcttaaaattgagaaattaaaagtcacttaggatgacaaaataatttgttgttcgaatagtgaagaacaattttgagagtaaaagcaggagttctttacggttatgtcaggacagcagacataaactggaaattctctgggcacaccaggatgagtgcttgccttgttcagacctcctatttggaggaagttagtttttgatttgcaagcatatccagtgttcgttcagtgttccttgcacagccactggtcctcagctatgtgggaggatcaagtcaatgccatcccattcctaccttggtgctatacagaatcaaccagacagaaggaatttacctggaggccatcaatttgggggtcctcttggtatctttttacttttctagaatttgcagcaacatgcctgcttgctaaccagtacacagaacctcagtgcattctagaacgtttattgcaaggccaaatatgttagcagtcacttccagaagatcccttggtaatttacccagacatcccagaagtcctctttcccccaagcccctcagctacctttttctctggatagttctaacactgacctggatctgaaacctatagttccaactccacttttccagagacacttcactcctagagttcattggattagaataagcttttttttcaatttaccagagatggtaaattgggcaaagacattcatttaagccaatggttctcaactgggggtgattccattctcccttgcccaaggacttttgcaatgtctaaagacatttttgatcactatgacttgagtgggtgaatgaagcaactgacatctgatgggtagaggccaccagttctgtggaaccacattgcacagaatagcccttcacctttccccaataattatcccatccaaatgtcagattccaggttgagagactctgatttaagtcaatgaataaacactcgaaaagggaataaaatgactatgtagtggtactcacattcctcaatattacccccaaatgagcaacttcctttatgtacactacctcctttataaataaactgataaattgtcataaagtcttgtaacttaagtagtagagagcttttctctgttagttttaactgagaagttgacttctttatcttacaactttgcaaattgttacagtgattttgagcaaaattcaatgctactcctacttctgattcttctagtgctgctgctaaacagtaacgatgtattgaatgtttactacataccaggcactatgctaagcacttatcatatgttatctcacctcccaacaatcttgtgagctaggtactattaccattgaactttactcctgaagaaactgagggttataaaggtcaagggacttccccaacgtcatcaatttgctaactgagaaagaaaggtgtatgagtccaggtatatctgtctccagagcatgcagacttagatgctatccttgactccctttctcaaagcaattccattgatagattctgtgtgtttgatgtcattagtaagcagtgaagaattgctgagggaagcttcttgaaaaaaaaaaaaaggatcagattcggaagttggcttactgtgacaacaggactactcccagtctagcttgtccatgaagctgctgccatttatgctgcagaatgaagagctcttatagtagattataaaaatggccacaatattatgtagcttcttccataaagaggtatttctccactccattaatcaggactgctttttgccttccttttggccaatagaatgcaacagaaatgactttttatgaattatgagcctgggcctctgctttcgtctcttagaacctgccactaccaaataaacaagcctaggctagtctggtggatgggtagagacatatggtcaccccactgaccaccagccaacccacagaagcagaggcatttagtcatgatcagcagccaatcatgatgtatggggaatcccaaccaagatcagcagaagaacttccaacctgagcccaaagcaaattgttgacccatagaattgctgttttaagttttggaggagtttgttatatggtaaaaggtaactaacactcatgtaaggtgtctacgtagtcttcaggctctcaggcctagaagaaaaaagtgtcttagacttttgggataaaatatccaagaagcccttgcatatatgtcctaggggtttggggaagacagaaggcctattcaggatagggtgaatttaaaacctagttgccaaattctttgacactgctccaattgaaatgggaggttgtgcactttaaccttggatctgagtactgtgattgcttgatcaacagaatatggtgaaagttacactgtgttagtttctgggcccaggccttaagaaactggtagtttccacctactgtctcttggaacactcattcttggaactcagccaccacgttataaggaaggctaagtagcccgttgagtggcccatgggatgagaaacatgtggagaagaatagaaacccttagctggccctcagccttgactgagctctcagatgacagtcttgtgagtgagccacttcgaagtggatattctaggccccagtcaagctgcccagctgatgctgcaaggagcagagatgggccttccctgtgcagtcctgagcaaatgtacatttgtgaactaaatacagatgctctttgacttatgatggagctacatcccaataaaaccactgtaggttggaaacatcataagttgaagatgcatttaatacacctagtctacatcatagcttagcctcttctactttaaatgtgctcggaacacatattatcctaatgttgggcaaaagtcatctaacacaaagtccataaatcaagtgttgaatatctcatgtaatttattgaataccatgctgaaagtaaaaaacagagtggttgaatgggtacttgaaggacggtttttactgggtgtgtattactttcacaccattatgaagttgaaaaattgtaagtggaaccaccatagttgagaagcatctggaaatgatttaatccaccaagttgggaggtggtttgctatgcaccaataaataactggagggatcctggagacatgagattctccaaaaacgtggtgaatgctttgctttgggggatgaacaaagggcctttctcccagcagagtgcttgagggcctgttttatctttctcgtagcacttactgtcaccacacatgtgcttgcttattcaagaggctaagcaatgaaaaagcagggactgtgttctcatcactactatatgcccaggatctagaacagagtccgacacacagtaggtgctgaagaagtagctgtggaatgaatgcaaagatggaagacagagagttgacacaatgctcagttctgattttgtgccaggacttttacttacagaattttatgtaatttcaaccttcagagaaaggcattcttcctatcttacagataaggatactctggcactaagaaaggaaatgatttgtacaatatccgacaactattaggtgggtaaacctgggtcctaacccaggttttttgaatctgtatcttaaactcttcctacaatgctgtggtgctttcctcttttgggcccagatgtccctacgaggacctaataagggtattttttacacacagcctgcacacacacatgcacacacattcatacacacaatggttgcatatactttcaggactcacagactcttggtataagaacccttttcttatgccatgaaaaggaaaggcacctggttcttacagacttttgctttgtgccttttcttcagctaaattgagttattaactaattatggcttgtgaagtcctcggaaaatactaaatatggttattagtgaagctttgattttagagaacagcaagggagtcctgaataagcaaataacagttgtgtagggaggctggcagccgacgacatgctgcggtgtataatcaaactctgcgaggctgtcaaaggtacttcagctcactgcttgctacattggtccttactgggagtttatacattttcagagaacaggattcattactaattgattgattttctaaggctccccatgtttcatcttccagcatctatttaacctttattctgcactccgcccccaaaccaactcttttactcacagcagataactctacctcttcttagaaaaaatagaagctccacctgaatttcatccctgcacccccaaatatttccatctagattattattacatctttcttggagtacatctagattacataccatctagccctgcttgcccccctttcagactatgcccccttcagaactggctttatgcacatgtgacttgtgcagtcacacaggactccactgtcagaaaggccccttgtgaagacgatgctctgttattgtcaccttgaaatttttcataatttttgaacaaggggccccatatttttatcttgcactgagccctacaaattacagagccagtcctgcccacttccagttgaatgtttgatgtgaatccttccagttataactgtgcatgttgctccaaagacctcacttcatcaataatgtcttgttctttcaactgttcccactatactcactgacaactttcagtctacaattcctcatccaaaagaaatgagcaaaattcctctgatcaaggtaatgactgtcagttctatattgggatatttttagggggtttcaagggacagaaacctaagtgaaactagtttaagtgaaacaaggatgtttattatattacatgaacaaattgtggaagagtcaggagtggagctggctacagggacaacaggactctaagatgtcacccctcttcatctgtattcgtgtccccatgctagtgtttttctttcagttatttttccatgtgatggaaacttgtctgtaggtagtgccagaccagattcctgcggcttggcatcaaagagaaaagggaccattgtcatctagtttgaataaatacaaaatctgatgaagagttctaattgtctctacttgggtcatgagtttattcttggaccagtcgctgtcacctgtgaaaaggggcactctgattggctgttgagatctgaatctcattgttggagttctgggagagcagttctctatgggaaggtgagcatgatcatgggaagacagagcaatcagtgtctaccctggaccccttctacccagaatctcggctctctctttttcccttcatggtcaatgccattgcaaagccatctatttgaaaaatagtctacattcactcacctgacttcttcacctcccaccacctctaaatatttttattgtctctctgaaactgcctttgtcaagatcatcactggtttccttgtggtcaaatctataggtaaatttttaatgacctcttattcacttccttgcaatatgttgcatctggttattctttcttaggaaatctctcctttcttgttttttattttttcctgggctttgttctccttgtctttcaaaccagctcctccaaggtctgtcttttattgatctcagtttccctgtttctgggcttgtctcctgatcgggttctttaacatgtcccatgaatctgccacggatagcttctcttatccctgatataccgtgcctactagtgctgaccatattttgccaattcagtcatccaggagagaaaaaacggtgaaatgggtttggttcagggtgtatggctattaacaagaaaataatgagaagaattccaacaattattaaaaaggtagaatcacttggacttgatgataggttggaaatggagagaaagagagagggagaggctgaaaataccttttaaatttctggcttgggactaggtggtggatgctgccattcacaaaataagggcagtaagtgtgcatgtgattaaatgtacatgcttttgagttccgggatgcctacttgggtgtacatacacatacgtgtatagtacatgcttatgtgaatgtacttgtctttttgtgagtgaggacttttgagcagttggaggtgtggagagcatgtggtataagtcaaggtatgcatgtgtgcagggtggtcaggaaatgaagacattcgcatatgtccacaggcatagaggtcttgagtcccaccagctgtgtaccccagagcctgtagttctgaggaatagccctgggcaacaaggaccaacacattctcttagcttatcaccagtctgttccttacattgtgcctgctttaagaagtcacacagcatggagtgtgcttaattaaattccactacaactttaaaaagagctaattgtagttgttagaaacatcaggtgcacattggctgatagaaggagacgggatgaaaggttgaaccttttctgtaatccttctcacctgccctggatctgaacttttatcagtctggggaaatgggcttatggtgtattcagtattgattcctgccatcttgttgatttgcaactctggaggagggttgagcctgccactggagctaaagaattccagttttggagcaacatcagggcagatgagggctttctggatccagaaatgggaagaaggtggggacagagtcaaagaaggtaggggcatatggaggcagttttacacttattactctctcctttttggtatcaaatttattttagggaaacacaaaccatcctcttttgtctactctccacttctgtcagttcttatcttcagtttcctcacatgtaatgtaatgttaataatgatatctattacattgggatattttgaagattggaagtaacagacgcaaatcacctatggcccagggcataccacctgttgctccccaccagtgggttgtggtagtgattgtggcagcagtaattgtagtagctgtgtggtgactactaaaagtagccacagatgattgttgaacacttaaaatgtggctagttcaaatgacacgtgctgtaagtgtaaaatacacgctggattttgaagacttggcataagaaaggtaaaatatcatcaataatttttatgttgattacatcttgtcatgatactatttgggagatattgaggtaaatggaaatatagtattaaaattaatttcatctgtttctttttacattattaaaatgtactcgtaaatttaaatttatatatgtgggttttattgtgtttctgttggacagtgctgttctagagaattcaggcaagaggtagtaatcatcagttccagaagtactgaattcttctggagtacagggatgaggctgataactccagggatggaggctactgagatcaagtttgacctctaattgctggaggtatcatgcagaaaaaaatgctcagacacagggcctcaagacagaggccctgtcccctacccacttgacactaccccagcttgcttatggacaccatcatctcttgcctggatggctctcacagctttcttctaactggtctttcttctaacagctttcttctaactgatctttctgcatgtctccaagaatctagttttctgtcactcctaacagccagagtgatttttaaaaatacctgattctactcaaagagattcatttaaatccctttcaggcagtctttttggaattaaatctaaggtccttgcaagcctggcctggaaggtcctccatgatctgctctcctgcctcaatttcctccattctctgcttcactcatattgcatgttgctgcctcatgagccttcattcactaaaacatgccagctgctttcctgtctcagggactttgcacatgccatttcttctgcctgcaacattcttgcctaacacctcacatagctggtaccttctcatgcttcaggtctcagttcaacacatcatctcctctaagaaatcttcttcatccacattctctaagtgccctagtttccctcctactaccatgttctttttgctcattccattatcaccatttgatattaatgtgattactcattcaatctttcagtcatcactatgctgtaagctccatgcaatgggtccatgtctgtgttgtatccaatagcacagaggctgtcatataggaggcacttgggaaatacttgctagaaaaagaataaataaatggaagtctgttgtctgaaccaggacacaagttcaatgacagccttaacaatgatgacctgatggagaaggactgaggctctgagatggggtgggaaggatcagccactccaggggagggaagaagaaagacacagaggctggagaagcaggcagggcccagcctgagcccagcaggggcagcttggctctgcctcatcacaagaagtagcttcagagctcttcaaaggaagcgagtcaagatgggtcagtccctggaggtgtcactggccctcagaaggcctctgccagggtttgatgaagcaccttctgtggcaggtctcataattaactgtgaccatgcagtgtgttcatgcagatgtaaatcatctggcagatactttggggcttatctgctaatgaaaactccttcgcatttctgtaagcatattatggtcaattacaattaattcagtttgcatcgactgccattttccttatgcaaagattgtgcaaatcgagtgtgtgagccgagggctctgaggcctgtaaaatccataatggttagctttcagggatggtgaggaaagaataaaactgtgggctgtttgaaatttaaatcagagcagggctggtcaatagaagcagaatggctgcacttggatttgttgggctggctgtgctgggggactaggggcatcttcctactacccaaggttacagggtcacagagtgtaccctgtccctatcagtttcttctctgggctccacttctgcatttctggctgcagcctctctaagacccaagggaccagacttcctgtctgaggactcatagccatgtgactcagattactgctacttgaagagagatgaggttttctctttttctttcccatagctccaaggagtaagttgggaagatagcaggtgttaaattgttaaaatttcgacttctggaccagctgacatttgttcactattaactgtgtgccaagaattgtgctcagtgcttatgcatgttttctaggtatgtgtgtgcatagcacacgatcctatgaggcaggtatttgcacttcataaactttatagatgaggcttagagaggtacagtggcctgttcatgacatacacctaagaaaagtttggtttgaatctagattttaaatcactgtattatacaatcactgggaggactgaatcgtataaaaagtgacattcagtctctattgcttttgttgtcagattcagctgcagtcaatacctgaagaagagaatggttctatgtcatttctccttttctgtaaggagagcagagaccacagggcttcccatgaaagtcagggagcttggcttgctgggcattcctaggcaggcaaatgacagagtaggacttcggttgtcaattgctgtacaagctaggatgacctctggccatgaggtgtgttggaaatctctttcagagtagcctcttcttctgaaagaccacactcagcccaagcatctagagagaacctcagaggctgcttgaatagtactgagtacagtggaatataggtgcggatctgtataggttgtggatttattgttcaaattttcttgtttttaccgaacttccaattgccatcaccttcatttctttacttaaggtttctctggccatgagggtccacgtggcccaagcatgtgacaagccagaagtaccagagaattaacattcctcaggagcatccctcaaccagtgagcagtagaatttgatgtgtaaatacctcaactccctcacccctcaggtaggataactctgcagtgcatgtgcaatgctggcttctggaattccccggcaggatcatgctccagttgcccatagcaataacctggttgataatacacactttattgcctgctttttcttccttctctcccttattggtatttcccgagatcaccttctaaataaaacaattgcacttgaatctttgtctcagagtctgcttctggggaaaccaaactaggttagctcctaaacttaagcataaactgacttgcagcactggccatgaacacaatagcaaagacagggaaacaacctaggtgcccatcagtggtagattggataaagaaaatgtggtacatatacaccatggaatactatgcagccataaaaaagaatgaaatcatatcctttgcagcaacatggatgcagctggaggccattattttgagtgaactaatgcaggaacagaaaaccaataccgcacgttcttacttataagtgagagctgaacattgcattgggtactcatggacataaaggtggaggaaacaagaaacactggagactactaaagggtgcagagaaaaaggaggaaagggccgaaaaactacctagtggatactatgctcactacctgcatgacgggatcattcataccccaaacctcagcatcacacaacatacccatgtaacaaacctgcacatgtacccttgaatctaaaataaaagtggaaattataaaaaacttaaaaattaaaaccttcaggcaaaaactctagggataatgacacagaaaaggttgctgcctgggcattagaagaacaccacacccaaatagctcaagcctgtggccaaagataagaacttggaggcatctctccttcctagtagggctcctcactttcccaccacttctttttaggcatttagctgagaacttaaaaggacccacaccatattcccttatatatattgttagttgccacgtgtgctctctgtctgcctggctcttccttcttgcgttgtgtgacctggggatggaggaggaatgctgtgtgctcctctctggccaccttgcatagctttaggatccaaaagtaatttaggaacaatgcttgaatttcacattgtggttgtgtcattgaagctgtgctcacaatctaacccctgatggtgaggtaaggatctcacataggtggatttgttgctggggctcttctgtttggacctccgtcagctgctggagatggtagctaccagctaagtaacagagaaactcaaagacttttgtctaaaagcctactgcaaaaagaaagtttgatgatttaaaaaattatttatttattttttgagacagagtttcactcttgtcgcccaggatggggtgcaatggcgcgaccttggctcattgcaacctccgcctcccaggttcaagcaattctcctgcctcagcctcccaagtagatgggattacaggtgcctgccaccatgcctggctaatttttgtatttttagtagcgacggggtttcaccatgttggccaggctggtctcaaactcttgacctcaggtgatctgcccacctcgacctcccaaagtgctgggattacaggcatgagccacccatgcctggcctaaaaattgtttaattttaatcatacaagtaaacataaatatattcttatggccaaaaaaaaaatcatactttatggatactgtcaaagtccccattgaccattcttcctagtacctttcctgaacagaaatgaccattgtcattattttggcatttctctttccagatactttctatacattcatgtgtgtgtgtacatgtgcagcaccccaacactcaatccactctacattttgacccacaatgtacttttttttttttttttttgagagtcttgctctctcacctaggctggagtgcagtggcacgatattggctcactgcaacctccacttcccaggttcaagcgattctcctgcctcagcctcctgagtagctgggataacaggtgtgcaccatcatgcctggctaatttttgtatttttagtagagacggggtttcaccatgttggtcaggatggtctcgaactgctgacctcatgatccacccacctcggcctcccaaagtactggcttcacaagatatttgagagttctttccatgtgagtacataaaattttacctcacttctgttaaatgctgcataatattgcattgtgtgaatttagtttagtttaactactcccctactgaaggatatttaggttgtttccaatctatgatggcttcagttgtgggggcttcctcctttgagcatgggctgtctccctgagggtcagttcccccaaattaagggctctctttgcagtaactttcttgtaaatcctgaaacagccacaagctagttataaaatgaagatgttatgaaaaccagttagaattgctggggaattccagacaacatcacgtgactcctccaagtccctagagaactagaatgagactctgaagaggtgggttgggacaggatgctggagagagaagaggggcaggggagagagcagggggcataagggctgaggaagaggagtcttttttgctcctaaacacttgaggttccatttgctaatttattgtcagaccacagaaaaattgatccctcctgctccagccagatgttgctttcttgagttctggccttgcccccatagctctcaccacatcaaggagaggactagcaataagaaatatatttttcttcagtaggattgaaatcccccctattgtgttcttcttcaccatctcagtcagggagcctgctctgggaatcataaattatcaggttaaaccatgtgaaggtaacacttttcaaagtcaaaaatggtcaaataccatcagtttcatatggttcaactgaataaattttcggagcaattccaatttatcttttaagtgatggggttaagatgacagtttggggactttgcctgtgacccttcaaaattccggggtaggacttaggatgctaattgttgcataaggtagggttgcaatttgagattaggttggttagaggtaaggttgggaatagatttgacaaacatgtgatgtaatttctgccccttgccaatcctttttccattgcagccgtcactaattgattaaagtagtaatgcttactaaacccagatgtgaatataagataactttcaatacatcactctaaataggcacagcctgttgaccagaaccagtactaatgatggagcccacagccatctgtcgtgggagggagagcttggtttgatgaagggatagatttaaggtgatgtttaggtttgcttcgggattatggccagtttaagtttgttttgattttaggataagcttagtcaaggaaaactcttgactctggcttagaagcaagattaattttgagtttcgagtatgaatggtttagtactatgtttagtttgttaatttatagttaaggttaggctggattcagagtgatgctcagatttgtgtttcgtctaacttggaggtcagggttgtgttcagaattagattgagtgaattaggagaactcaatattcagcccttaaaacttccacttttttaactgtcctgtggtgttaaaagtagcagcagtagtccaaaaagtattatacttggatgatatctctaatatgcatgcagacagataagcaactttggtaaattacttagcaattctgggaacatttttagcatttggaaagagcaatattaatggtactgcactgtgttttattttaaatgaaacttatgtaaagtgtttagccagtgtttgttagacaataggcagtcagtaaataataagtctctttatcttttttttttttgtgctggcatcttattgcttcataaaactgatgacaatggtagttacaatttattaagcatttactgtgagagacacaatgattttaagcctttgacacatattacagtcacacactgcataacaacattttggtcaatagcagatggcatatatgatggcagtcccataagattataatagagctgaaaagttcctgtcacttagtgatgttatagccattgtaaggtcatagtgcaatgcattgttcatgtgtttttggtgatataagaataaacacacctactatgctaccattcatataaaagtacaacatatacaattatgtacagtacataatacttgatagtgataataaatgatcatgttactggtttatgtatttattatactatacattttattattttagagtgtactcctattttaaaaaaatgttgattggtggctcacgcctgtaatccgagccctttaggaggccaggttgggcagatcacttgaggtcaggagttcaagaccagcctggccaacatagtgaaaccccgtctctactaaaaatacaaaaattagctgggcatggtggcatgcacctataatcccagctactcaggagtctgaggcaggagaatttttgaacccaagaggtgggggttgcagtgagccgagattacaccactgcattccagcctgggcgatggagtgagactatgtctaaaaaaaaaaaaaaaaaatgttgattgtaaaacagcctcaggcagatctttcaggtggtattccagaagaaggcattgttatcatagcagatgacagcttcaggtgtgtttttgcccctgaataccttctagtagggcaagatgtggaggtggaagacagtgttattaaatgatcctcaccctgtgtaggcctaggctaatgtatgtttcttagtttttaacaaaaaagtttaaaaagtaaaacaaaattaaaattttatagagtaagaatataaagaaagaaaatacttttgtacagctgtaaaaaagtatttgctttaattctaagggtatatacaaaaaaataaaaagcaaaaggatacaataacaaaccagaagataataaccggggtaattatccttagataaaacaaagcctactttaagaaaagcaggattatcagagataaaaatagacattttataatgatgagagggtcaatccactaggaatatgcaataattctaaattcatgtgtacctaattaacatagtttcaaaacttatcaagtagatatatggacaaccatagtggagctataattttctcagagctgacagaacaaacagataaaacgtcagtaaagatagagaagatctggttccaattgacgtaattttcataaatagatctgatttactgaattgaacaaaactagctgacttaattgaatactaatttagtgttgataaaatattttttaacaccacacatggactattaagtaaaattgattatattttggaaaagaactcaggtttcaccaaatttaaagcattaaaactgttcagcatatattctctgacagccatggaactgagaaacaaataacaaaaataaaattagaaatgcttaaatatttggatattaaacatttcatttctaaataacctgtgagtcaaaaataaattacagtaaaaattagatagcattttggacgataaaatcatgaaatatgaaaacattcggatgcagctaatgttgtgttagagggaaatgtatagtcccatatttttatatgcataaagaagagaagctagaaattgaccacctaagtattaatctcaagaagttagaaaatattaaacacaaagaatatgcaaagaatatgcaaacacaaagaaataaaataacaaaaatcaattaataatacaaaattaataaatgataaaacaaatatatgataaagacaaaaaaaccaaaatgttgattattagagaggctaaataaacatatagcaagactaatcagacaaaaattagagatggcaaaaattacaaaatgagaaaagagattaatatagattatataaatatcaaggatataatgtaaaattttacactgattcattaaaaaatgaagattaatgataaaaattccataaaaaacatgatttgtcaaatttgacctataacaagaaagagactatctgaatagtcatatgttaccaaatatattaaactgaaatttataatcctccctcacaaaaatctttaggtgcaaattactttgccagtgaaattttaaagaaatttatgtaagaaataatacaaatattatgcaaacttttaaaaaaattacaaataaaaaaatcaggatactattctttggtcagtgagtcccaaacaaggacattacacaaaaggaaacttataaaaacagtcacattatttattatattgatgacattaaagaaaaaatgtcaacatctcaatacatacagtaaaaacattggaaaaattcaagacctgatcattgtaaaattgtgaagatatctaaaaataaaaggaaatttactaaatctgataatatctatgaaaagtcacagagcaagcatcacataatatttaatagtgatatattaaaaattttctctgaagttggtaatgacctaaggatgaccactattgacatttctaatgaaaattatagtagaggacttatccaatgcagtaagtcaaggaaaaaaaaatgaaatgcgtaaagattgagtagaaagaaataaaactatcattttttgtaaatgacatgaatgtatatgtagaaaatttatatatactataaaattaataggggaaatttgcatggctcagtaagttaacatgaaaatgaattttatttctattatgaacaagcaagatataaaaaatgatgttattatttaaaatgccatcaaacttctcaattacctaagaataaattgaaaatggcacaagatgtatgcacaaaaaaccattaaacgttgttgagaaaaattaagatataaaaatcctgagggatatagcatgttcataccttgaaagattcaatattgtaaagatgccaaccctcttcaaatcattgaatgattcaatgtgatccctttcaaatatcagcaggttttttgtgtatatctacttgtgtgtgtattgtatgtgtgtatccatgcagacataacatgtttacctggaaatataaaggacccataattgccaagatgatttttaagaagagcaaaattggaggacttgcgcttatgatatcatttattttgaatgagtgatatcagcaatatctcagaataggactttccaacacttgtctccttagagaaacatcaatctgaacacctatgcaagcacaaaagtatcttcagaagagttaagaaatctaggtgagagattatggcatctgagtggagcacagaagtaagaaaagatgcattgaaaacggtagaaaggacagttttacattacttgcatcaccactcccccaagccaaggcagtgcaatgtggagagagatttcctgtatatgagagaaggagaatgcagtcagcacctgatttcacagtggacaccagcactagacccatttcagtgaacttcagtgccaagctagcctatatggctccagtttccaggttcagccctgcagacccaggcaccaggcctaggcctaagggcccacgtgctcgacctactccagtgaacactggcctcaagccaacccctatgaacacaggaccaagaacattctcatgaacaaagtacaagcctgccccagcatcatttagttcctatggactcaggctcaaggccaatccaatgttggctctcacatacccaagcttcagtctaggccttgtggacgcagactccaggcctgtccagtagactcagttcacccctgtggaccttggcaccaagccgatctccgcagacccaggatccaggtccatccttgcctaagcatgaggtttatgttttaactccaattgctctaaccccagtggatccaggctccaggattgctttcatgtactcaggcaccagttcagcccctgtgggtccagatgtcaggccagcccacctgctgaccaagacaccaggtcagcctacccaggaactctaagcaataaggctgactgtactctgccaccagatggcctgcacagaatctctggataggttgactggtaaagggatttccttgccaaagccagtctgtaaagaatgtaagaggcgcctgcttcaaatgcacagacaccaatgcaaggccacagggatcattagtaatcagtgaaatacggcaccactaaaggaacgaaataaagcaagagtaagtgactcaaaggaatggagatggaggagctgcctgacaaaaaattaaaaataatgatcttaagcaaattcagtgagctacaagagaacacagacagctgaacaaaattaagaaatacatttacaaaatgagaagttcaacacagaggtagaaattataaaaaagaactaagcagaaattctggagctgaagaatacaatgactaaaccgaaaaattccatagacagcttcgatagtagacttgctcaagcaaaataaagaattagtgagcttgaagatagatcatttgaaattaaccagttaccaattactcaaattcagaatattgaagagaatctaaaaggaaagataatgagaaagagtgaagaaagcctgtggaacttctcaaacaccatcaagcaaactgatatatgcagtatgggtgtcctagaaggggcagagaaagaaaaagaagcagaaagcttatctaaagaaatgatgacagaaactttccaaatctggagaggaaaatgaatgctcaaatttatgaatcccaaataacctcaaatacattaaacataaagaggtttcactaagatacattataatcatattctcaaaagtaaaaggcaaagagaattttaaaagcagcaagaagaaagtttccttaggtgcaaggaaacctttttggttttttagagatggattcttgttaggttgctcatgctggaatgcagtggctattcacaggtgtgattccactactgatcagcatgggaattttgacctgctctatttccaacctgggccagttcactcctctttaggcaacctggtggtcccccacttccaggaggtcaccatattgatgccgtacttagtgcagacacctaattggcatatcatataacaccccagaactcctttgctcaagcgatcctcctacctcagcctcttgagtagctggaactacgggcatgcaccaccatgcctagcacatacaagggaacttttgcaagactatcagtggatttctcagcagaaactttgatggccaggagacagtgggataatatatgcaaagtgcttaaagaaaaaacctgccagctaagaatactatatctgaaaggctgtccttcagaaatgaagcaaaataaagacttctccagaaaaacaaaagctgtgggaattcgtagccactagattttccttacaagaaacactgaatggaattcttcaagtcgaaacaaaaggacataactaatgacataaaatatgtgaaagtggctgggcgtggtggctccctgtaacccccagcactttgggaggctgaggtgggtagattacaaggtcaggagatcgagaccatcctggctaacatggtgaaaccccgtctctacacacctagccaggcgtggtggcacacgcctgtagtcccagctactggagaggctgaagcaggagaatcacttgaacctgggaggcggaggttacagtgagccaagattgcaccaccatactccagcctgggtgacagagcgagactctgtctcaaaaaaaaaaaaataaataaatgaaaaaaataaataacaaaacaaaaacaagatgtgatagtacaaaactcactgtaaatataagaaaatagtcaaattcagaatactctaatattgtaatggtggtgtgaaagtcattttgaattctatataaagcttacaagatgaaagtattaaaacaactaaagctataataatttgttaatggatacacaatatacaaatgatataatttatagcaccaataacaaaatgtcagaggagggaagttaaaatgtagaatttttgtacgtggtcaaagttaagtacttaaacagcttaaaatagactgttataactgtaagatattttttgttagactcatggtaatcacatagaaaaaacatgtagtagataaacaaaaaaatgaagagaaaggaatcaaaatataccactacaaaaaaatcccatcataaaggaagaccaccagggaggaagaatgaaacaaagaaactacaaaacagtcagaaaataattaaaaatggcagtagccagtccttaacctgtcaataattcctttaaatataaatggattaaattctccaacaaaagacatagagttgataagttgatgaaacccacaatccaactatatgataagagactcattttagctgtaaagacacacataggctaaaagtgaagggatggaaaaagatatcccatgcaaatagtaaccaaatgagagcagggttggctacacttacatcagacgaaatacactttaagtgaaaattgtcataagagaccaaaaaggtcattatgtaatagtaaggggtttaatatatcaagaggatataacaactgtaaaaatatgtgcacaagcaatagagctcttaaatatataaagcaaatattaacagctgaaactagaaatatacagcaatacaataataataagaggcttcaatactccactttcaaaaattgatagattattcagacagaacatcaataggaaaacagtggacttgaacatgatagaccaaatggacctaacagacatatagcatattctgttcaacagtagcagaatacacaatcttttcaagaacacatggaacattctccaggacagatcatacattaggccacaaaacaaatcttaacaagttttagaagattgaaattatagcaagtgtcttttctgactacagtggaatagaactagaaatcattaacggaggaaaattggaaaatttagaaatatgtagaaattaagtaatgcattaatttccaaacaactaataggtcaaagaagaaaagtatctcaagccaaatgaaaatagaaacatatcatactaaaatatatgggatgcaacaaaagcagtcctaaaagtttatagcagtaaagtcttacattaagataaaagaaaaatctcaaataaattatgtaattttacacctcaaggaactagataaagaagagcaaactaagccgaaggttaacacgaaaagaaagcaataaaaattagagtagacataaatggagactagaaaaacaataagaccaacaaaaataaaagtttgttttttgaatgcgataaaatagacaagtcttaagctaatcataactaagaataaaagagataaaacaaataaataaaattataagtggaagagaagacataactgataccacagaaatacaaatgattgtgacactatttccagtaattacatgctaacaaactggcaaacctaaaagtagtgggtacattcctagaaacatacaaccttctgagatttgataatgaagaaatagaaaatctaaatagaccaataacaagtgacatggtttggctgtgtccccatccaaatctcatcttgaattgtcattcccataatccccacgtgttgtgggagagacccagtgggaggtaatttaatcatgggggcagttaccttcatgctattctcatgatagtgagtgagttcttgcaagatctgatggttttagaagggcttttcccccttctgctcggcacttctccttgctgcctccatgtgaaggatgtgtttgcttcctcttctgtcatgattgttaagtttcctaaggcctccccagccatgcggaactgtgaatcaattaaacctctttcctttataaattactcagtcggaggtacgtctattagcagtgtgagaagggacaaatacaacgagtaacaagattgaatcagtaataaaaaatctcccaacaaaggcaagcttgggacccaatgactttactgatgaattccatcaaacacttaaagagaaactaatgccaatcgttttcaaactcttccaaaatgttgaagaggaggaaacacttccatacttactctatgaggccaatattactctgatatccaaaccagacaagaatgctttaagaaaataaattacaagccaatatttctgatgaacataggtgcaagaattctcaacaacatattagcaaactgaactcaacagcccattaaaaacatcacacaccatgatcaagtgagatttatcagtaggttgcaaggatggcttaacatatgtaactcagtacatgtgatacatcatgttaacaaaatgaaggacaaaaaccacaatatcttcttaatagatgcggagaaagcatttaacaaaattaatcatccattcatgataaaaactctcaaaaaataagtatagagagaatgtacctcaacctaattattttgataaacccatagctaacatcatattcagcagtgaaaacctgaaagcttttcctctaagatcaggaacaagacaggaatgctcattcttatcacttctattcaatataatactgaaattcctagacagagcaattaggtaagacaaaaaaaaggcatccagcctggaatggtgtctacactaagcttggcatcaatatggtgaccttctggaagtggagtaccaccaggttgcctaaggaggggtgaactgacccgggttggaaatcgagcaggtcataactcccatgctgatcagtagtagaatcactgcactgttcctttttgcaggtgacataattttatatatcaaaaatcctaaacacttcatcaaaaaacttttagaactaataaagtcagtaaatttgcaggacacaaaatcaaagtgcaaaatcagtagcatttctatacactgacagtgaactatcagaacaagaaatcaagaaaattatctcttgtacaatagcatcaaaaaattaaatacttaagaataaacttaaacaaggaagtgaaatatctttacactgaaaattataaaacattgatgaaagtatagaagaataagtggcaatatgtcccacattcatggtttgaaaaaagtaatatcattaaaatgttcgtactacacaaaactatctacagattcaatgtaatccctatcaaaattacaatgacattttcacaaacattagaaaaaaatcctaaaattcatatagaactacaaaagaccctgagtagccaaagcaatcttgaataaaaataacaaaggtggaggcatcactacctgatttcaaaatctactatgaagttatagcaatataaaaagcactgacaaaaaaaacaaacatgtggaccaacggaagagaacagagagcccagaaataaatccagacatttacagtcaattggtcttttacaaagatgctgaaaaccaccaatgggagaaatgacagcctcttcaataaatagtgttggcaaaactagatgtgttagttcattttgcattgctataaaggaatacctaagactgggtaatttataaagaaaaaggcttacttaggtcattattctgcaggctgtacaggcatggtgccagtatcttcttgacttctgtgagatctcaggaagttttaactcatgatagaaggcataaggggagcaggcatgtcacagtgaaagagcaagagagagaggggagaggttccagagtctttctaacaaccagattttgcatgaactcattaccatgggagagcaccaagtcattcatgagggatttacccctcatgatctgaacacctctcactaagccccacttccaacattgcaaatcacatttaaacatgaggtttggaggggactaacatccaaaccatattgctagatatccacatgcaagagaatggaattgaacccttatcttaaaccatataaaaatcaactcaaaatggatgaaaggcttaaataaaagacctgaaactgtaaaactacacatagaaaacacaggtaaaagcattttgatattggactgggcaatgattttttggatatgatcacaaaagcacaggcaatgaaagcaaaaataggcattgcatcaaactaaaatttttctgcacaacaaaggaaacaatcagcagagtgaagagataacctacagaattggaaaaatatctgcaaaccatacatctgatcaggggatcatatccaagatatgtaagaaactacaacaacttaacagaaaggaaacaaagaacccaatttaagtgtgggtgaaggacccaaatagacatttttcaaaaaaagaaatacaaatggccaaaatgttcatgaaaaaaagtccagcatcactaatctttagagatatgcaaatcaaaaacacaacgagaaatcacctcacacctgttaaaatagctataatcaaaaagagaaaagacaaaagttggcaagaccgtggaggaaaagggaacatatactgtttgatgggaatgtgaattagcacagtcattatggaaaacatgaatgtttctcaaaaaattaaaaataaaactaccatatcatcccatagtctcacttctgggtatatatctaaaggcaatgaaattaatatctgaaaagatatctttaccctcatgaatattgtagcattatttgcaatagccaagaaatggaatcaacctaagtgtccatcaatggatgataaaaaatgaaaatgtgcagggtatgcgcacacacacacacacacacacacacacacacacactcatatacacgatgaaatattcagctttaaaaagaaaatatttgtgacaatatggatctggaaggcattatgctaagtgaaagaagctagccacagaaagaaatattgcatgatctcacttacatgtggactttacaaatgtcaaactcatagaaacagagtagaatggtaatttcgaggggttggatgttgaaggatatggggagacttggtcaaagggtacaaagtttcagtttggcagggtgaatatgttctggagatctactgtacagcatgataattctagttaacaatactgtactgtatgttaaatttgctgagagaatagatcataaatattctatcacatacacatgcacacacgataactatgtcaggtgatggatatgttaattagcttgattgtggtaattatttcaaaatgtatacataatatatagcatgaaagcatcatgttgtatgccataaatatatacctttttttatcaattatacctcgagactggaagaaagggaaaaatatttatttcaaagttgtaataattaatacagtatgatattggcacaagacaaaatatgcatggaacaaatagagaaccagaaatagatccaaacgtgtgtatccacttggcttgtgacaatggtgacaccgcattgcagtgcagagaggtcattccttcaataagaggaagtcatattgggtcgattggatagtcacatggaaaaaaacgaatctggagctgtatcacacatcctacacaaaaataaattccagatacattatagttttaaatgtaaacagtaaaaacaacaaaatgttgtaaagataaatttgggaatattttcattactttagagtagtttaatatttcccaggaaagatacaatactgcccataaaaagattgttaagttgatcttaattaaaattaagaatttgtatttatcaaaatacaccattaggagaataaaaatgcaagcaacagagtgggaggtatttaagatacatttattcaacaaggggatattatccacaaaatatttaggaagtgtttctacaaatctgtaacaacccaattggagatgggcttaaaacctgaataggctcttcacaaaagaggataaaaatagccgataagcatatgaaacaattttaacctcattagtaattagtaaaatgcaaattgaagtcacaataaggtgccaagtgttggtaagaatgtatttagaactttcatactcttgccttatgcaatgaatccctcaatcataatactgaatgaaagcaaacacaaagatatcttttacatgaagttttaaaacaggtaaaactaatggtggaatatgtaaaaatggctgttaatttttatagagagcttgagagagaacacaaagaagcttcaggggtgctggctatattttgtttcttgatctggatagtaattacatgggtttatataatttttttttgcatggtcacatttttacatgcttgctattctatattaagcgttcatttaaaataaaatcactggcccggtatggtggctcatgcctgtaatcctagcactttggaagcccaagatgggcagatcacctgaggtcaggagtttgagaccagcctggccaacatggcaaaacctcttctctactaaaaatacaaaaattaaccaggtgtggtggcacacacctgtagtcccagctacttgggaggctgaggcaggaaaatagcttaaacccgggaggcagaggttgcagtgagtggagatcacgccactgtactctagcttgggcgacagagtgagactctgtctcaaaaaaacaaaaaatatatatgtatatataattaaatcactattaagaacttcagacagttgttgggagaaaactgccttagtcttccaaagctcaggtttttgcctagtatgtgtaatccaggggacatccaacagtgtgtctggggagggacagtcttgtccccagatctgtcaacattttttcattataacaaagcccatatgactcatgtataaaactctgaatgcaatgttcttggaaatatgacaaggtccaactgcctagttctcccaagcagcagcattacttgtgtatgtgagagagggatgaggaagtggggaggagggagattctgtttgccaatctagaccagtgttcctccaacttttttgaaatagagtttcactctttttgcccaggctgcagtgcagtgatgcaatcttggctcactgcaacctccacctcccaggttcaagtgattctcctgtctcagcctcccgagtagctgggattacaggtgcacaccactatgcctggctaaattttgtatttttactggagatagggtttcaccatgttggccaggctggtctcaaactcctggcctcaagagatctgcctgcctcggcctcccaaagtgctgggattgcaggcgtgagccactgtgcacaactttttagtatacagtgcagtcacatggagggtttgataagacaaatggagtggaaccactttcaaagtttctgattcagtaggttgagatgggcccccgaattttgcatctctacattcccaggtgatgctgatgagaatgctactggtatcatactttgagatcaactgatctagagcacttattgatgagcactttacggagacagcaaggtggcactggtggtggggtgatggtaactggatcataggtcagagattcagccattaggctcagattttattgttcacagcaggttctatgtaaagactctccttttcccagaactggatttcatgagtttattgcatgagtttttacaagagagttcaattacaatacaccaatgccttattcttgcacatggcaagtcaatatgggcaatatgttcattgaacatccttccccactcatgatctcattaggactttggcattttaaatagttcagcttgtaaacccagggccatctgtgcaggtgacctaatccatgtctctgatgataactagcacccatagtaaaatgaatgcaaactgatttcaatttctgtttaaaaaacaaacgaaaccttactttatacttggcattagcaccagtgttggaggcagggagtgtggtggaaatggggagggaacaaagaagcagcagatacagctgcctgctttcctgtcatgaggtttactttacagtacatcatgtgtctcaagaccagctgagtgttacattttccatccttaaatgacacttgctttgcacatgtatttcaaaggcttagagttgtttgcagaactctgtcccaaccacaggacttcccatcctgcagctggagagtcttacatgcagaagggcctgggactttccaagtgtggggtgtcatatctagcagctctcctttctcatctcttgggtttgacttgtcctgaactaccccttgctatagactagccacagtggcgtcatctgtttagtctggacactgctatcatctttggcaccccagtgctccctggtctgtttaccttaggcagtattgccagctaaagaattgctttcccctgctctcatatccatccacagtcaccaatagggttcgctttcccatagacctgctctatgttggtttttatcagctaagataatccaccttacgggctggcagcagaggccactggtgccctggctacatcctcaccttccagtgtgctctgactggtttccagttgcatctgcatctctgtgcctgaggattcccccatttcaaccctgaaccctgaaagattgctctgcctgtttgtacaacaggccagatgttccaggaagatcccttaatcaatggctttcaggcactgatatatgaatatcccagattatttgcttctaggctgatgtaattctggtatgattagcattatttcccagaattttcccatggtagctggcttaaaaacacatgtattggcttccttccaaggaatttttatatttgacagctatttactgagtgcctactgtttgccaggcactgtgctagatttgggatataaatgatgagtaaagcagatgtggatcttgtgatatcgtgggagaaacagataataaacaatcactcactcacaaatgtatcattttaaaattgtgataagtgccattaggactcacacaaagtatatgatgaaggaactgagtgtcttacctacatgatgcagtgactgggtaaggctgcattgaggaggtgatttgaactggaggcctagaggatgaaaatcagccatatgcagagctggggaataaaatgtgcagatattggaacgggaaataatttaggatgttcttggaatggaaggagagctgacagaagaggggacagtggtactcaggttggataggcaggtaggcaccagatcatccatggccttgtgaagcgcctaggtgggtggtatgtgtgggcatgtgtatatgtttctgtatgcgtgtgaatgctgtaacatatatgtgccttcttctctgtgtttgtgttcacccagtggtatgttagtgaatgggatgtgtttgcatcttgactatgtgtgtatctgtccgactgtgccactgcatgtgtgggtttttgtgtgtatgaaggcctgtatattgatgttttcaaatagacttttttgatatgtatctataagtatgtattaatatatttttactatggtgatatctaggtctgtaggcctaattatttatgagtatgtctataaagatatatagataaatgtgtcattgtgcatgaaagcatgcacactgatatgtatatttgagtgtaaatatatttgtattatggtattgtataggtgaatttataggtgcctgtatatgtgtgttttatgtgtatatgattaaactagaactagattgaacaatattctgaaattagtgtctgtgtctctgtatgaagctcaggaaatagtctttccctcaaccagaccacaaaaacttggaatttttatagctcacatttgctagcaagatgcaaactttacttgcagttacagttatggcttgctttattttacattttcaatattcctggcctttaagaatctgaattctaaatactttatgtgaatgagtgaatatgtgtgcatgtgtttaattctcttggtttcagtaagtcagcttcagttaggccaaaatccttacccttgtctttatgcgttaatatctttatttagaaatgaactttagacctggagtcgagtggttgcctcaggcagcttttttttttttctccattaatatcttagttgtaagatgatccagcagtttgattgtcggggaatcaaatacaaggaggccatccttgagccccatggatgttcttatagactgatgttgtcagagaaatggagacagcaacttccagggaaagacaatgagcagctagagtctgagctactatctccatatagagtaagtgggcccagtcctttgaatagattttccttcaattcccgattctggcagcacacaaaaaaagattgttgcctagtcatgggacacaggctttggcatgactatttttatccaggcaatatctcatgtttggtgctctatttattcttccaactagaattgtggtgtgtgatgatgcccttaaagatcatccattctagtctactttacaaactcttctttcatgggtggacattaggctgctccttcaacacctctgtggtagattgtgttgatgataggcccaattaatggcctctctgtatccatgctcattgtattttaactttgtagttccctcccactttgcctctgggattagttctgtgacttgctttggccaatacgatgttagcaaacttgatgcaagcagaagtgcgaaaaaacacctgtgagtttttacttcctctccctctcttttctgtgatcaccctaaaaataagcccacactagcctagtggaagatatgagaccacgtggagaagagctgagttaccccagctaaggccatcttggattagttatcctttagcaagcctaaaggctaaggatagatgcgtagtgtgagcacagccaaggtcaattcaactaacccatagattcaaaagagttaataaatggttgttactttaagccactcagtttggagatggtttgatatacagctgtagctaactgatataacctcaatggtagggtgcttattatcactggaggcagtccatttcattgtgtatcaattctaattgttatgcggtggagctggactctgcattataacttctgactatgccctgtgagtgtcagtggaaaaagctcgtatcttctcccacaatgaccttcaagtatttgatgatagtgatcatgccagatgactagagcagcttccaaactaaattatccacacagaagttatccttgttaaacaaactggattatgttataccttgctaaaaacctttccatagtttctcattacacttagattaaaacccaaacttctttccattgttctgcatcatccatatctgtttgtctcaacctcatcctgaaccactcttgcctttgctcatgatgctctcatcatatcgacattctttatgttgacagtgctaagctttttctcacttgatggtcttttctcatgctattccctcctgcctaggaataaatatgtgttgacattcctgaatcttctcttctctgaaccaaacatcttctgtgtctgccattattcttcaattgatataaatgtaggtcttctcactaatctgattgcatgctttagtgtcttgttgcctcattttgaatatgatacccagaaatgaccatacttcttgggcatgactacagcaagaaagttatcttgttctttctgaaagaagtctacatgcacccaaggtatcgtgccaccaggatagaaagaaccatgcacattcacttatgatggattggctaggtggataggatgacgaatgcttggaaaacagactatctggcttctaccaggtcaatggcaaagaccttgtagcctcctaatatataagaggttgatgtgtacacagattgacaggacagacaggaatagtcaccaaggatttgtcagtggtttcccttgagccttgccctagagatcagctcaatctagagtgggttggagtaagctattgtgtgtctattagcacagaggccaaagcccttctcagctcctcagttctatgtgaatctctcaccttcaatctcatcctgaaattagtttatctttaagtcatagataaatacaaagtctaacaataggctagtaaaagtcaagtaatagtaactcataattgtggagcatgtactctgacacaggttctttctaagcacttaatttgctttaaccaatcaaattcttaaaacaacccttttaggtagaactagattaaaccagttgtttcctaaccaactgcacagtagaatcaccagaggagtttgttgaaaaatggaaaaataaaaacaaagcaagaaaagattacctgactctacccaatattgtttgctaaatcacactttcttggggtggggtgggggcagggggccaagataatctgtgttttaaaaacagctctctgcttgctccttcagcaattaacctggcatctgtgagctggcatttgggaactaataaattatgtcagcctttcccatagtatgcctcacaagatgatcataggtggcatacagaacattttttaattagattttaataattacatatttatttttaaatatgtgcatgagaaaaaggtagcatattgaatctgtgtttttatagatattgctgaggaaaggcttaaagtgggtatttaagttaaaaaaaaaaagtgagttgatttagagaaaattaagtagtgaaacaggtatactgataaggttaacactcaaaggtggcaaatgaatggccaaagtttaggatactctgagaaaattctgagatccctttgattcagtgattctttcattctatgtggcatgtggctttgggtaaatatgcaactttgcatttgaatttgcttatatgaacactttatcagtagttttcaaactttcagtagcagaactttttcaaatggaatctctcttacccctgaactccccaagctatctcaccccaagatttccttcagtctcagctcctgaaacctgacctaaattaaatcctagctcttgtcttacacaaggaaatggaagcaagggctaacattgatgcagctttgccattcaaaatgtgctcgacagtaaatcagctttctaagggcatgagcgcagatttgcattttggatgttgaaatgaaatgaagatgacctgtagaaagacaggaattggagttcaggtggggataggatgggcctagaagactttattctctttctaatagcaattcacctctttttcttccaaccttagtcatgcgcttctagttctacctttatcagcagtgagatttcctcaacttccttaatctcagtatgattccacctataaataaacattattatgggggccagctcatagggttgctgtgtgtattaaataatatatattcttacctccaggtctggcatatggtgtttgctaagtactagttactaccatctccaaagtcattttagcatcaaagataaatgcatgttaattgtttaacctccagtaaatataatttaaaacaagtaaaatataatcaattatctatttcatgtatagctttgagtgtttcatttttttgaatacaaaaatgtatatgaccttcaatgggtttaataatattcttactttccttaactccttaaccttatttgcctcatgaggcattcagttctgtcatgaaatctctgaccacagatatatttcaggaggccaatcttagcacttggagaaagcttcttttaaaattcatcacgtttattgagcaattttccattctctcacaaagctccctactacttaatctcacttgagcaagaaaatattcctgtgaagtgggtagggctgaacttattcccattttacagatgattaaactgaataagctttggaaccatctcctttggaagcaaagtaactcactatggtctaaacactttgagaaaagagagaagaaaattgagatgaattcatgctttgcctcaattccctgtatctttcatgttaaattaccttgcttcatgttattgctgcaaatttggctttgttagtgcagacctgacctggatctgtctatatttctgcatagagagatgaccttaatgtatttgcagaatctacatgctgtccactaaaggccacccagcaaatgcaaatgtagcaaatggaaaatgcatttcaggtgcaggtcaaaaactgtcccagcaagaaaaataactgcaatgacggggactctggctgtccagataccttctgaaagtctctttgaattaaaagcagagcgtctgacaatttcatgactaccccatctgaaaatgcagtcttccctgaggtggagggggtgatctaggtcactgacttgccctgccagaatcttaccaacaaaaaggtatcagttgactgagtggaagtgacagggactttgggaaaggtgacagagtgagaagttaggaactgggcacagttagaagacaggaatatggattgcaaacaagtgaaagaaaaaacacagctcaaatttgtagggtggtgcttcaaaaagtagtgtgactatgactggaaatctcctcaaagtgccgttctgcctgtgcatattttcccagtgacaaaggtcatggagtggtaaccagagaaatccatgcagtgagccagggaactctgtgatgaaagtgaatgcaaaaatggcacctgagagatggaaagaaggactcagaattaagaacaaaatagaagaggtggaagggaccaagaagactgtgtcgtggcagggggtaaagctcacccctatgctgagggttaaaatatgttaaggaaagaaaaacaaacaagcttctaaaaatcatccgggtccagtgtggtgactcacacctgtaatcccagcactttgggaggccaaggtggtaggatcacttgagcccaggagcttgagaccagcctgggccgtataacgagaccctgtctctatgaaaaatataaaaaaagctgggcatggtggtacatgcctctagttccagctgctaaggaggtcgaggctgcagtgggccaagattgcaccactgcactccaggcctggggaacagagtgagaccgtgtctcaaaaaataaataaaatgaaagtcatgtgtcagagaagcagatctagatctagatcctagatctctgaaggaataaataggttttctggtactgaggagggagctggaaaaagagaatttaagcctgaaaagtgtggagggggctttaatgagggagaggaggtacaacctctcaataggaggaagaactagacgagagaatcttacttctcttgcgagctcacttctcatagtctcctcaggttctgagaggacttagggttgggatccttgagtatcgctaacgaactgacagaattgatggagaagaggtgagagtggtagaagatgggagaaaaatgtcatcccaaatttcaacagaggaggaacatagcttccatgaaccactaggtgagtagtttgctgtagatccaaaaggaggttatggaatggattattaaaggagtttgtttgtgaacacatggagaaggaaataataatcacagggactcagcatgtgttttcccagaagtcatatcaggtcaatctcatttttccttttaccccattatgtaatgacagacagattaaggaagtgagactgttgctaggatctaggagatcagctagacatttgacaaagtatcacataaaacctttttggacaacatggataaatataggtaagaagacaaatagtaatagttatagtaataataataataataataataacaacaacaacaaacacttactgagtttttactatgttagaccatgtcaggattttggtattctttgaactatcaatcacaaaataggctgctgtcaactagaagagaggtctccagtggtgaacccagcattgtgtgtttttgatcctattcaggtcagcacattgattcctccctcttctaataccttggccttatccatggtttcaatttggttgatgaacatttattgccaatcgaaaatagtcaactcccacggtactcttggcactcgggtacagttgagtgctagaggtaggctgataggttcaaataaccagtttggttatttaccgtctatgtgaccttagtcaagttactcattgatatggttaggttttgtgttcccacccaaatcttatctttaattgtaacccccatactccccatgtatcaaggaagagaacaggtggaggtaattgaatgatgggggtagttcccccatgctgttttcatgatagtgagtgatttctcacgagatctgatggttttataaggggctcttccctcttcgctcagcactcctttccctgctgccttcaccttctaccatgattataagtttcctgaggccttcccagccatgcagaactgtgagtcaattaaaccactttcctttgtaaattacccagcttcacgtatttccttacagcagtgtgagaatgtactaatacactcactgtctccattttttcatttccctatctgtatgatgtgtgaagatattagagatgttatgaaaattaaaggagacaacaaaagggaagtaagtgcctgacaagggtaagtgtgacaactggcatggtgtttgcctttttggaaaaatataatataacctggaggttgatcacctgcagagaatacagaggacaatgaatgacaaatggctgggagggagggaaaacaaacacaatggggacagtcagaaatgaacaaagagcttgacaggaaggaatggtgggctgaatccagtatgatagaaagtaccaggagaccagcctgaccaacatggagaaaccctgtctctactaaaaaagaatacaaaattagccgggtgtggtggcatatgccggtaatcccagctatttggaagactgaggcaggagaatcacttgaacctgggaggcggaggttgaggtgagctgagatggcgccatttcactccagcctgggcaacaagagcgaaactccatctcaaaaaaactaccaggaataaatgtttagctaaaaaattccttccatttcaaagtagaatatgggagattggttaagcagttactcagataaagaggattgtgatttcagaagatggcacagtttgagtcaaaaatgagaaattcccctggccaaaatgtggtaatgagatttcaggttatattaatagaagtatggtatcttcactgtggaggtgctggtcctctctggggcaccaatcatcccatagctagagtattgtgtttgggttttagtaacattacaaatatgggtggggttatcatctgtccaaatcagttctctggtgtcagttatttaatggtttcccatcacacttaaaaatcatatccaggctgggcgcagtggctcacgcctgttatctcagtgctttgagaggccgaggcgggtggatcacgaggtcaggagatcgagaccatcctggctaacagggtgaagccccgtctctactaaaaatacaaaaaaaattagccgggtatggtggcgggcacctgtagtcccagctactcgggaggctgaggcaggagaatggtgtgaatccgggaggcggagcttgcagtgagtggagatcgcgccactgcactccagcctgggtgacagagcgagactccatctcaaaaaaaaaaaaaaaaaaaaaaaatcatatccaaaatcctttccatggtctacaaggtgcttttagtctctctcctccccatcccccatctgctacctcatttcttactacttcatccattagcttctgttgctgatcttcaagcaggctaagtgtgttctcatctgaaggctttctcacttactgtctcctctacctaaacacattttccccagaaagttctttggcttgatccttcacttaattcaggtctctgttcaatgctaccttctcaaaaagagacatttctaatactttatctaaaaaatgactcaatcactgtttcttcatgctgtttcatttttaaacaaaacggtattctagacggcagggtactccaacagacctgcagctgagggtcctctctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctcaaaagcagagcgcctctcctcctccaagggaagcagttcctcaccagcaacggaacaaagctggatggagaatgactttgacgagctgagagaagaaggcttcagacgatcaaattactctgagctatgggaggacattcaaaccaaaggcgaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatagaagatgaaatgaatgaaatgaagcgagaagggaagtctagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacactcttaaagaaaagaattttcaacccagaatttcatatccagccaaactaagcttcataagtgaaggagaaataaaatactttacagacaagcaaatgctgagagattttgtcaccaccaggtctgccttacaagagctcctgaaggaagcactaaacatggaaaggaacaactggtaccagccgctgcaaaatcatgccaaaatgtaaagaccatggagactaggaagaaactgcatcaactaacgagcaaaataaccagctaacatcataatgacaggatcaaattcacacataacaatattaactttaaatgtaaatggactgaatgctccaattaaaagacacagactggcaaattggataaagagtcaagacccatcagtgtgctgtattcaggaaacccatctcacgtgcagagacacacataggctcaaaataaaaggatggaggaagatctaccaagccaatgggaaacaaaaaaaggcaggggttgcaatcctagtctctgataaaacagactttaaaccaacaaagatcaaaagagacaaagaaggacattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacggaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattgaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagggaatactacaaacacctctacgcaaataaactagaaaatctaaaagaaatggataaattcctggacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaatattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaaggggcaaaaactggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcataagcattcttatacaccaacaacagacaaacagagagccaaatcatgagtgaactcccattcacaaatgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctcagccaaaagaacaaagctggaggcatcacactacctgacttcaaactatactacaaggctacagtaaccaaaacagcatggtactggtaccaaaacagagagatagatcaatggaacagaacagagccctcagaaataatgctgcatatctacaactatctgatctttgacaaacctgagaaaaacaagcaatggggaaagcattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgactaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttcagaagaagacatttatgcagccaaaaaacacatgaaaaaatgctcatcatcactggccatcagagaaatgcaaatcaaaaccacaatgagataccatctcacaccagttagaatggcaatcgttaaaaagtcaggaaacaacaggtgctggagaggatgtggagaaataggaacacttttacactgttggtgggactgtaaactagttcaaccatgtggaagtcggtgtggcgactcctcagggatctagaactggaaataccatttgacccagccatcccattactgggtatatacccaaaggactataaatcatgctgctataaagacacatgcacccatatgtttattgcggcattattcacaatagcaaagactcggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaactgaacaatgagatcacatggacacaggaaggggaatatcacactctggggactgttgtggggtggtgggaggggggagggatagcactgggagatatacctaatgctagatgacgagttagtgggtgcagcgcaccagcatggtacatgtatacatatgtaactaacctgcacaatgtgcacatgtaccctaaaacttaaaagtataataaaaaaaaagttgtatttagatatcattactgctttaatacctaaaaaaaaaaaaaaaaacaacggtattctacatatctatgtgtcttttattatctggttccctcattagaggaggcactatgaagggtagggacttaactgttccggtcacagtctagcacagtatctggtacaaggaaggctcatagtaggtgctcagtgaaaaaattgttgaacgatgaatgaataattaaataaatgaatgaattaataaacactctgtagaactcacatttcatagaagacattttggcaaaagttatatgaagtttttaacttgtctattctggaaataaggcagaagaaaaagtagggaagtagcaaagatatgggacatttgtctaaattttgtaatggctatagtttttaatctcttttttttaagatggaatctcgctctgtcacccaggctggagtgcaggggtgcgatctcagctcactgcaacctctgcctcctgggttcaagtgattcttctgcctcagcctctcaagtagctaggattacaggcgtacaccaccacgcctggctaattttttgtatttttagtagagacggggtttcaccatgttacccaggatggtctcaaactcctgaccttgtgattccctgtcttaagatattcctaaaattcctccttcttaggagttctctttccttggaacctagagataagtcgtcctcttatctttgggacacttctaggatgaagacactcttatgtgatgttgctcactttcctgcacctcctctgagccctgaccccataaggctgattgtcccccacatccccttctctctgttctttggggttcttcaggattgcatttactatctggttgtcctttgggagaagtggcagattattgtctatccacccttgcatatatgtctcccagttttacaatgccaataaatttcttaaatacattttaaaatacaactcttttattgtaagaattatggctgtcttgtgtgtgtgtgtgtgtgtgtgtgtatgtgtgcgtgtgtgcacacgcacatgtgtttatctcacagcatttaacacaaagcctggactgtaacaagaactgagaatatatttgaaggttttaagaatggtttgagaagactttttggttaaaaaggtaattcagatatacagaagtgttttttttttttttttgagacacccattcacaaatgtgcctttcttccagaggcattcatttattcatccatccgttcatttaacacatatttactgcatgtccctatgtgctttcatgccctggtctcagcacatcctgacttgagccctgccctcacacagtttcttcacatcagcttggcaagaaaaaggggcaattcttgaagaatcacatgttttactcattgttccattgaacactgctcagagaaagtgtgattagaattatggagaaggggtaactgaactgagcaagtattaagtgtctcctcttctaatccctggacctcatccatggtttcaatttggttgatgaacatttattgccaatcaaaaatagtcaacttccacagtgctcttggcactcagggttagagttgagtgctagaggtagactgatggattcaaatcccagtttgtctatttaccgtcctgtgacctaagtcgagttattcacgttctccagtttttcatttctctatctatgctctgttacccccaccctccaatctttgggtctagcaacaccccccttgaggctttttctaatgctcaatgaacaacagaatttcatgccctgacccaactctcccctgctcaaaattaacttaaataataaacaatcaaaaatcatagaccatgagaaaacaagaagtgggaagatgttagagatgttatgaaaattaaaggggataacatatgggaagtgcctgacaagaataagtgtgacaattggcatggctcttgtctgtttggaacaatataatataacctggaggttagtcagctgcaggtaggagataattttgaatagaaaaaaatcttcaatgtatagtaaatttactttttcatagtcctaagtataaaggcactcagatgaagggtattgagaactctttctccaccatcaaaacccacaagatctgctatcattttaaccagtgtgtttgtgtgtgtgtgtgcatgtgtgtgtgtgtagaggaggaggacagtactttcttaacctcctcattcttcaaagtctttatccaattaatccagaaggtatgttgcttctatatagcaggcacatgttggaaaccaagtctcaagaattggaaggaattcctacatactcagtaattccttctcttccttcctttcttccctccttctttcctcctttcctttgtctctccctttctcccttctctcattatttaattaatggttaatggataacaacttggcagcaggcatctttactgtcctccttgggctcttacgttcatacatgtgggtcatggattatctaaaacagcgtccacaggagtgctgcctttttccatatgaccgaatcccttgccatcacctcttgctcagcacctcagccctttcagatgtgcaaccctactttgaatttctatcctttgggaaagaggaaccattatggattttaagcagaggagttatttctgaagattaactggggaaggaaagaggactaagacaggaggcaggaagagagaccagtccaagtttctaatcctagttctttccctacacaggtgtgtagccttggagaagttacttaaccttacaactttatttacttatctttaaaatggggggtaagaaaccccatctcacaaaattattacctgagttcagtgcgaaaacaagaaggtgattttggtgcctagtatgaatggagtgttcaataatgatttcacagttctttccttttctaacactttgtctttaagatgagaaatgagaattgagcctcactgttgttcacataagatcaaaatggctttattgcaagtaagcttctaactagatagaacccattgttttctcagggtctatgattcttggttattatttgatttaatttcgagcaggggagagttgggtcaggacatgaaattctgttgttgagcattgggaaaagcctcaaggagggtgttgctagacctgaaggttggagagtgagggcaagagagcagctgaaacacaaggagaagctgggtgctctgaacccagcaatttcactgtcagtaattctagctgaagccctgttcttggcctggtcccacctgcccatctataattaaggtcgtgtctacagttatacagattataaggaaagagaagaaggatgtcatcaagtcataatttccagaatcaaggctcctattttctccatctttttttttcctccctattttggatttggcagcaggtttcctaaaaagtaggccatcatgtccttttttacagttcattacgagtgggcaaggagggccccctcaggctgccaaggccttgatgctggttttctcaggcagcgagaagggagcgtttcctggatgctcacctctggccaggaggcaaacattggttatggaagaatttttccttttatttctaaacaagaggttgtaataaataaggaatcatttgcaaatgtttgcatatccagcccaattttatttttaattctacagtgcatgtgtgctgatgcatttttgatgtaggaaattgttacagatgtaaagttggaaaatttatttgagggtcttgggatttgaagattgcattggaactgtcagtgtcagcccttttgtgacagagttcatagaaggagaacatttgagaacaaaagagtaaatgaaaagtatttgatctaggctgtgactctgttgttaacattattttcataaaaataaccatagacctgacctggcagtctgtgaacacagaattgtttccttgatggagggtagcacagttaagaaagaggatgcctaaatcgtgggtcaaggaggtgaaaaatcagtaccccaggtgacacagtgctgagtgtggatgctatgttggctatgtattcctggttttgtttgtgttaagactcaggcttaaaagttataaagcaagttttgagctatatatagatgataagtagatattccctgaattgtgaaggtttcctttatatagcccaataattgtatatttgcgttctctcccatgtcccctttgattgactagtcttggctgcctgaaggagatcttttagggatgtctgatttggagatggacagggacagaagtggctcatgtattgtgtgcttgaccttctaacccaagagagtcctcaattgcaggcttacatccttcttggttcttgtggggtccccacatcaaccaaaggatgttctttctactgctgcctcttagacatcttcttctcctccttctcctcctcttttctttcctcttcctcctccttttctgtcatttccccctttcttttcctctttcacctgcttttcctttttctctaccctctctttctctttctcctttcctctctttcttgtcctagaaaggaaactcacttgtgccaaacacctgctaagtccttttacatatgtatcatcttatttaattctcaaccaattcttatatttagaattccatttggttacatggatgaattgtatagttgagtctaggattttagtgtacctgtcacctgaatagtatacattgaacccaataggtaacttttcattcctcactcacccctagcctccctgcttctgagcctccagtgtccattatgccactctgtgtgcctttgcatacccatagcttagcttccacttaagtgagaacatgtgatatttggttgttccattcctgggttacttcacttaggataatggcctccagttccatccaagttgctacagaaaaacattattttatagaatcccacttttagagattagggaacagaagcacagagagacccatcaaggtgacacatctcagagcaggacgaggacccaagactctctggaatggtagctcccgccatccactgtgatggccttggtcctgccggctatcgtctcctcacccccacggctgctcctttcccctgtcccagagttgtcagtagcgtcttttggtgcttgagtgccttggctaatcatgaaagactgaattggctagtgagaactgtgggagtgaaggtttatttctttttttaaattagaaaaagaagtcccctcttgtatcatctttgcttctctataaacagtctttgaaaggtacagttttgaccaaatagccctctggtgggaacttccaagaagaatattctggagcagcatctgagtatctgacaatttctcagttagtgcagctggatcatgacgttaaccggaaccaccagagctcggattcccaaaacctaatccttggggaaggttgggggaggtgtctgggacagagccgacatttgagctgatcttttgcaggcactgctgatggggcagagacctgcccttacttaagcttgctcagtgtcagggtaaatgtggggccagggtgtgagggctctgcctgccaggaagaggaagggcagattggctgaggctctgtagaggcttcgtggcaacagcagttccatctcccggttctgcattggcccatggcagcttgatttccagctgccccaggtggagctaagttactgcatgagttgagtttcctccaagggtagaaaggacacatcatgtcctccttcttcccagcattctgatttttaaggggcactaacccagcatctgagccatgtgccatgtgcaaatacacacacacaagtacatttccatgtctacttactcagttggcaggacatcaaagttcctttccagaggttagataaaggggctgcaggacaagagggcaggaaggatttaaataattgatcaagatgtgcatgtcagagccttgtcatttatttgcttgtttgtatgtttgattctgttgttttgatttttaaccacaaatcaatggtttctttgccaacgctcttgctctaagaaggtagactaatagagaagaaacttttagaaacgagtttcctgagtctattttaagtgattcttaatcttaggtgcatatagaaattacctggggaactttaaagaatattgatactggagtcacatgcctagagtttctgatttaattgtctaggttgcaaaatgtacataataatatctaaaagctctataggtgattataagtgtcaactacgtttgagaatcactggcctatctgacaccttatatttgtatgcaggcagaaggctttattaccacggcaagatattcccatctgtaatcataacaaaacctaaatagctaatctttgggtactcatgggctggccagtgtgtgaggtgttttgcctccatcagctcattgaatccttatacaatgtatacctgaattacctggaggactgttaaaacacaggtgtctggtgtccacccccagcttctgattcactgggtgtggtagccgcctctaagatggtccttcctcctgctggccatgatcttgtgtaatgtcctccccttgagtgtgaactagtcttattggcttaattataaataatagaatagggtggaagagagggaatgtcatttttgacaccaagttatagaaaatggcataatactgtgggccgggcatggtggctcacacctgtaatcccagcattttgggaggcagaggcgggtggatcttttgaggtcaggagttcgagaccagcctggccaacatggtgaaaccccgtctctactaaaaatacaaaaattagctggacatggtagtgggcgcctgtaatcccagctacgcaggaggctgaggcaggagagtcacttgaacctgggaggcagaggttacaatgagctgagatggtgccaccgcactccatcctgggcaaaagagcaagactgtgattaaaaaaaaaaaaaaagaaaaagaaaaaagtactgtggcttccatcttgggcacactctctcttgctctttgttggatcatttgccctgggataagtagctgccatgccatgaggcagccctgcagagaggcccatacagcaaagaatggaggtgtgcccacagccatgggaatgagcttggaggcagaccttgccccgattgagactttacatgagcccacagccccatctgactacttgatagcagcctcaggagagacctggagccaaagccacttagctaagtagtgttcaaatttctaacatggaaactgagataacaaatgtttgttatttttagctgctgcaatttgagataatttgtaatgcagcaatagataatccagtaaatctggggtgaggccttagaatctgcatttctaacaagtgcctaaataatgctgatgatactggtctgctgctttgaaaaccactgctttaccctaatactgagaggctatcattagtatacctttacccattacacagatggagaaacagctttagaagttttaagtacctttctgaaggtcacatacaaggtgggtggtgctgggattcaaacacaggcaatctgttccccagagttcatgcccataactcccttgctatgctgcctcttcgtctcatcatgaagtgtgtctattccttctgtgttagattatgttgattgaattgtatctaatggtgatggctgctaatgagggattttggtctggaactttattgaggattataattgaagtggctttcctccatgacacaaatgctcccccaaattaggattactactgggatagtaataatttgtctttggatatagtgtttttcaaaccttggcatgcagtagaattacttggaaggcctgttaaaatacagattgatgggacccatcttcagtgtttctgatgtagcaagtttggggtagaacctgagaatttgcatttctgacaatctcccagtcaaggctgagggaccacacttagagaaccactgcttttgtcaaagggttatgatgctcatcctatgttgagaagtgctattttggctgaatactctgagctgtttagtgcagagagaagcacaggaaaatgaagggccctaatgctcctcctggtgcatatttttaccccatgtgccttcctgctagggctagaacatatggttggaggaaccatgcagctgggctctttctgcacgtcccatgcattccaggatgagctcagattccattctaattatcgaaggcagagtgtggttgcaggcacccaacagtgctgctttgtgggaggtgttgctgtttgtgttagatcttgagaaactgaaatgggaatgttgacaagcgactgcttgggcaagtctatctatattatcagttgtacaaacagagtaaggatggggcgcagccttgacaggtggaggtatgaatgaatacaggttaagccaaggctggcctttttttttttttcaagccaaactatggaagaactgttttacattttggatgcccagcaacatttcccttgccaatggaacctgtgttttctttctttttttctccatctctgatcaactccttcattcaacctgcagctgtatggccaattcttgcctggccagaatgggccttggtgttggcatatggtggttgagccttggccatattggagagtagagctggttcgaagcctggagcaaggacaccttgccttcctttgcaccagtactgaatgtatgtaagaaccacagctggcagattaacttggggttgccgacagaaagtttgcccttttctactgtccaacacttccgggagactcacagtggatattaagctcaattgtagaactatctttaacaaatatatacccaactctacctctgtttagtagcactaaacagatagcactaaacagacccatggtcatgtggtatgagagaagaggtgctgtggtagaatctatttgcttacaatttttcattccctttttgcccttgtcatccttccctgtagacaaaatactctcttcattctacggagtttggggctattttgtgacttgctttgcctagtggcctatttgccatacaagcttttacagatattacaagtttctatcattctcttattctgattctccatgataagatgagcatgttccaacccgatagacattgctcctcagcctggtcatatagtgatcagacctgcaattcacccacaacttgaagtagtgtcttagagccacagttgacctgtagctgatgtgtaatgtgcgtgacaaataaatatgtgttttgtaagctaagatttgggagttgtttatcacacagaagaagctgcaaaaagctgactaacacagagctagagccaaatcctcatgtagattgcctgatttctcaaggaggaggtgtttgacatacagagccgagctttgtttcacaaattcagaaactcttactagagtggccacttggaaatgttgcctaaatattaaaagcaaaatttgtatatcttcaagagaaaatacagaacatctgtatgagccagcagtagaaaatatttttgtgaataaaacataaaagattgataagttgagtaaaatgaaataagatttttgtacaacaaaggactcataagcaaaaagaaaagaaacctcagaggtgaagatatatatgcacacaatggttgtgtagtaaaatcagaatatgtaatgaattcctacaaatcagtaagaagacaaggaaagcaataggaaaaatggcaaggctattgtcaaaaattcatagaagaggtaacaagaatggccaaaaccaggtagactatcctagtaattagagaaacatgaattaaacaatgagccattctttaacaaacatcagacttgcaaaatttagaaactctgccaatatgaagactatgttggtgaaaatatactctgtgtctgtgctaagaatggctgagacacaaatcttgttcttgggggacttagcatctaatggagaaagcagacatgtgaagaggtaattgtaaaaccttacgattaggcattgtagtgatgaggcatgctcagggtagagtaggatctgaggagggatcctgactcactaagcccatgggagacaaggaagacctcacagagaaagtgacatgaaagggaaaaagagaattccagacagagggagatggagggattgaaagagaatgggtctgattagggaaaatggcatagaattgaaaaatgtgcaatagaagaattgacacagaataattgattccatattgtgaagaaatgagtcagtgatatagaggaaaggctggcaaaactctttcataatatgggggcaaaagacaaagagataaacatttgcagagagaagatcgtgactgtggaggaaatacagtattcatataactgatattgctgaaataatggaaatgataatcaaatggcttgatttagccattctaaaacacatacatatattaaaacatcatgttgtataccataaatagatgtaatttttacctgtcaactaaaaataaattttaaaaggatataatggaagaaaatttgaggaggcgaagaaatattgaagaagttccatttggcaaatactagaaataaaaaaaaaagggaaaacaactaaaatctagacatatgctgctctttcaaaaaaatttcaaggacctttttttcctaattagtaatgttgtttttatctttttaattataaaattaatgtatatttattttcaaaaattagagaaatacacaataaaaaattacatgacatgataatattactaccaagaggtgccattactattatttatgttctttagtgattctctttgctatttatacaaaacagcgattgtattgtgtgcatgtatatacttttatgcgtacatatatgtatacatgtaggtatatacatgtacatgtgtatacacacaagcatgtgtgcatatgtatatatatatttgtacaaataatttatttcttttttaactgaatttttagatgtatatagaaagaaggatcaatggaacagcatagaaaacataggtagttgaagtctcaacatttttagttatttttgcaagttttgttattttcattatgatgattttcaaaatattctgaatttgcagttttgattttttttactcaacctaattattactttggagaggttttgtatattatatattctcctgaaagattttacattttgcctttcatatttaggtcacatttccaagtggctgttttcttggttcatattctagaaacaaatccctggtttttctctgctgtggtcagagaataggcctgaagagacttttcctctttggaacattttgaggttttcatcagggcctaattatgtaatcatatttttgtaaatattctagggctctggaaaagaagactgttttttttttggtttgtttttaaagtaaagcatcttcactaacacttggttttggcagacttttctaatttgtgtaaatctgatagttgtaaaacaatatttcgttgtggtttatttcacatttctctaatggcttgaggaattgatcatcttttcatattttttagccattcttgctttcttgtccttgattttctgattatagcctttgcctttttcttattggtttatcttttattgattattttataaggatttattatattttctaatatatgagttagaagtaacttctacatgtctgtagcttctcttttcttttgcttatgttgtcctttgtcatgcaaaagacttttaatttaatttgtgtcaatttttgttttcgtgttttgtgcttttaatattttgcttaagaaaatcttcccctatgttagattatgaggatattttcctctatgtttctcttgaaggatttataattttgcttctcacaatcaagttttaaactcatatggaatttctccatatatatagtgagaggtaggcagtctatttatttattttttcactttatatggccagttgctacaacattattaaataaattctttcttctctaagtttttattgccaccatatatttgtagacctgtcttggagctttttacttagtgctgcaggtaaatttatctttgcctatactgatgccacactgttttagttactgtggcttcctaataatttcagacaaatagtagggcagatcacccatccttattcttcaaaattgttttgactaattttggccctttactcttccacatgaattttaacatcagcttatcaattgccatggaataccctgttatgatattcaatggaaacatgtatttatatatgaatttagaagctcttgctttatttatgatactgagttttttaaaccagtggcatggtgtatctatctctgtatttagaattatgttcttacatatagttttataactatcttgataaattcctgcctgtttgcatttcctttttgcatttattcttagatattttacactttgtgctgttcttaacaatgagatttataaattttattatagtttacagtttttataggaataatattgaatttaatatactgctcttatattcaaaaataatggtaaatattttttagtagttctagcaactttctatattgtcttttattttcagtattgtctatgggactaacagtgatgattttttctttctaatccttcatacctcttcttgcttgcccgcattgactaggacctatatgatgcagaataggtgcaatgataacagcattccctattctttgtcctgactttaaagagaatgctgctaaactcttaccatttcacataatgtgtgctggaccttttagctaaatatgctgtatatattgtatcaggaagttctcactactttccccagtttgctaagaccattttttttcaaaatcaagaaaggttattaaattttatcaaatgcttttattggcatcttttgagatgctcatatgctcgtataatttctctcctttaatatgttaataaggtgaatttcattaatagattttttttaacatttaattatgctgggatccctggcatatttccgacttgatcattatgtgtttgtgtgtgtgtgtgtgtgtgtgtgtgtgtatacacatatatattttacaaaattatatataatacatatatattaaaaatacatatatatacatgaatccgtatactatatctccagaatttattcattctgtaaaattgaaactttgtacctttgaccaatatctccccatttccctcaccccctaaattttatacatatattatatataacatatataatacatatatacacacatacacatatataaacacatgtacatatacatacattgttgcattcagtttgctaatattttaattaagaggctattgtaaaatttgctgtctatatttttaaaacctagaggtaaacttggagggaattatgctaagtgaaataagccaggcagaagaagacaaatactgcacaatctcacttatatgtggaatacaacaaagttgaactcatagaagcagggagtagaatgatggttgctagtggctgggggttgggggtggagaaaattgggagatattggtcaaagagtacaaagttacaattttgcaggatgaataatttcaggagatctattgtacagtatggtgactacagttaataaaaatttattgtatacttgaaaattgctgagagtagaccttaaatattcttaccacaaaaataataaatacgtaaagtggtaaaaatgttaatcatctttattcaatcatttcacagtgtatgcacctatcaaaaatcatgttgtacaccctaaatatatacaattttaatttgtcaattataccttaataaagctgagaaaaattaaaaacattctagaagtatttttcaaatttgcctcctctatttttcattaccattttctttaatcatttttaaaatctcttccataaatcaaggtattacttcttaattttcctatttgttatgcctggtgactctccatagttgtggttcattttcttatttggtttgtaatttctgattctgaactcatcttcagcagtgattgattgctctggtagaatccagtagttctgtctagcagaatcttcttttgtgaatcttcatgctaatacctgggatttttctggttccccttcaaagcctaaacagttctttgaggatttcatgtttatatacatttctaattcgacccttgctttatacagaccttgggttgtatattcctatccttctgtggacagtgaaacccctgccatctgttcctgactctgaaagcatcctgaaccattgcagtgtcagctcatacatttcctgcctttatcttagcatcttgagatatatttttctttctttcaagagcttctatgaatttttacataaaaatttatatcttggattttactcaggatttctgtcagtttgttatgggagggagtacttttttcagaactcctggtatgtcatttttctagaaattcaaaatctcttcattttatttttaacttttataattatattatctctgcaatttttcttgatcttaaattacctttgtgtctgactgcagtagttttagtagtttgattcttttccctaatacttttttgcccttttacttatttaatctgattcttctgaatgcccattttttttttaattgaagtatctctttttagattcagggtcttttgactcttgacaaaacataaaaccctttagagcagtgcttctcaacctgctgtctagaggctaccagcattagaaccatcttgattctttcttagaattgaaaattccctggcgttcctctcattcaagatgatcaaaatcatggaggcaggatcctagaatctatatttcaaacaaagattctatacacttggagaattgctattaaatgaaaagatcaatcttatccagtatcagttcatagttaaataaggtttaagttttcttatttgtgtttctacatgtttttacacagtcctctagcccgaaagtaggaagacaaatgtccaggttttctctgaattccagttcccaacttggacatccagaagcctctggtgagtcaggaaggagctaaggctagaaaccctggtggatctggtggtggcacagaggaggccttcatcagtgggacatccaacatcttctccacatttgacatggtgtccagaattgtcccattcttttttttttttttctgagatggagtcttgctctgttgcccaggcttcagtagagtggcacaatctcagctcactgcaacctctgcctcccgggttcaaatgattgctgggcctcagcctcctgagtagctgggattacaggagtacaccaccatgctcggctaatttttgtatttttagtaatgatggagttttgctatgttggccagtctggtcttgaaattctgacttcaagtgattctcccaccttggcctcccaaaacgctagattacaggcatgagtgagccaccgtacctggcccaggagtgtcccattctcaggccttacatactagtaggtcctttatctgcccttggtggctgatgaagctggaagatgtagaggaccaccaagagccatggtggaaacaagatgctattgacctccagtggtgagatggaccccacataggctggccccattgccctcagattgacttatcagcagctcaaccctatgagtcaatttctgctgggggccttcttctctctctctagacaggctatcctttaaaagaggaagtcaggcttgtgccatccttctttcccctcccatctgaatattttggggggctggtcaagattttggtccctgtgtatggtcttttgggcattttagtgggactctgagaaggcagaggctttatcagtttcctttatgtatattaatgagtttcttggaatattttcacagcatgggtgtgaggatgagctacaagaattttcaatgtgaagttgagtgattttgcagttgagtcggacaacaactctgaaggttgctcttatttccccatatttatggcctctcaagtattagtaaatctaaagtatgtgatccaataatttagcaaagtttaacttgatgggttcaataatttaaaaattttaaagaagcaatgggttagtaaatttgtagttattttctaggtaaaatagtaaatgatattattttaagattaaataaaattttcacattgtttcatttatactgaaaaaaaggatagtagaatttcaaaagactgaaaaaatttatctataggtgggttgaaaaataaatattacagctatttaatttcccaatttctttttttgtgtgtgtatttttacttcttttctcatggcatcaacatttctgagccttttgctgctagttgtctaaaagccatttggcctttcagctcaaatcacaaaccccaatctctaacttccttgaggttgcaacttgagcacctgaaaatgtggccagcttcaagccagagtgaaaatgtttttttctttcatcccttttgacagcatcccaactaacaccactgcaagagggaaatgtcaaattgaggtgaacacccagctcaggtctgatctctgagccatactgcctcgtttgaatagggaaactaggaaaggaggggtgataactcagccatttctaaaaaaggaaaatgataacaacctttggagggccagccatagaaaacagccctgtgagtgcatgtcaaagcagccaatctgcttctgcttaggcagatgtcatgggcctggatcaaaggaaggcctgctccgtgccatgtgctcctatgaaagagaaagtgggtggaaactggaggcttttgttggtctttggtgttttcttaacaagagaacagcctcctagagaaacagcgaaagagccaggtttctgcaggagaggatcccacggagcagcgttggctgaggtcccttcagtgtggcaagatgctgctctctctggtggagggatttgggttcacttcctcgacggaggtggttccctgaggccacccaacattcaccaggctcactgccccatccttgctcttccatgctgcctctgtgctcctggtcaggatgtttgtcagtgcttgagaagggaattaccatgcccattttagaatggaagaaaattaggttcaatagagtgccctagggcacaaagcttatatacccgagtctggattaaaatttaggcctgcctgatgctaaatagcatgatgttgggcaatccactcactgtctctggttcttacttttctctctgacatgggtgattgttaaggtcagatggcattcattcattcaacaaacattgtgtgctaactctgtgccagaaactcttccaggtgctacagatgtagcaacaaacatccctgccttcacggaacttcccatttggtaagggaacacagacagtaaacaaagataatgtcatatgcagtatttcagagagtgtcaggtgctacatgggaggcgggtagggatggaggggtaaagaacgctggtgggaggtataagatttttagctggggacttcaggggaagcctcatggataaagtgacatttgagtaaggagatgggagactgagctacatggataattaggggacaatattacaggacgagtgagtatgtgccaagtctctgatgcaggagtgaatgtggcacatgcaaggaaaaacaagaagtcactgtggctggagtggatcgaaggagagggtgtcttggtcctttcgcgctgttttaacaaaatactgtaaggtgccagcagatccagtatccgctttctggttcagagacagcacctccttgctataatatccttatgtagcagaaggggcaaagcagctctatgtggtcccttttttataagggcacttatttcagttattaggactcttcctttatgacctaatcatctcccaacagtcccatcttctaacagcatcacgttgggggtaaagatttcaacttaggtatttttggagacacaaatattcagaccatagcagagggaaagtagaacaggatgccatagaggtaatgttgtggtgcatgggagggggaaggttgtcacacacagcaatctgtaggcctttataagagatgatgtatataaaaacatttttgatggtcaaagggctgtctaaatatatatgcaataatgtatacatatctgttttgggatttgggttctagactcagtctgcatagtaggttttagtgtctcactctcagttctgaaattctggctcttggaaagtcattgttctcaaatgggatgccatgatttgtaggtgtaatctatcccattgcaggcattaaattcttgataaacacataacatacgttcttttctgaaattgaatttgtggctactatggctgtgcatggatttttaagttgactggggttattatggggtgcaatgtcttaagattataaaagctgagttgtagcttaatgccaagccaatatcaagtaaagacctaattctcctgaaatgcataagaaggtcacctagtgaggatggaagtgaggaagatcagaatggtgaactgacaactccatcagcatcccagcaataaagggagagaaaatgtattattcagtaactgtggatgcttttatagacactgcaagacattgttattatatagtagtgcttgtgctttcattatggttgacctgttacaatctgttattcggatattttaattctgctaagcatgaacttcaaatattcaaaaacgtgtggcaaagatatacaagtaaaaaagaaggttgagaatgaatattttagaacttagagactgtacgtgctgtgttactgttgggtggatcacttttggctaattatgaaatttagatacactgattagtcaggtttgactcttgcattaaataaattattttgctttgacattgggtacttggtttacaaagtactctacctttcatcatcagattttatcctcacaaaactcttgtggaggaggtagtatggaattgtcaccttcatactacaaatgagaaaatagggaaatggcatggttttcccagtcacactagtatatagtggcagcaaagatggaatgtgagttcaaaggatcaacaaactcataggttctttctgtcctagactgacttgtgaataatagcacaatagaggaagacagttgggtcaaattagttatatgttgtgtgtagaaaaacagccttccaataatggcacttcccatgttaattattttgcatggtgtgtaaaaagagcttgacacctatgtaggaggttcaaagcagctcccaaactatattgtcttcatgcagcccagctaccgactgagtatggctagattgtcagtacactgctaacttctgtgttctctcctgtaatagcagactggactctgcaggcctgatcaagtaggaatgggtgggttgaaagtcgtgatcattataaatcaattatctgcagtttgctcaagtaagggtccttgtcattatgcattatagcttaattttcccaactaaattgacctttcagtggcccatgcccattattgtttattttagaaaacttctaccattgcccattctttagagcagagctgcccaatagaactttatagaatgatggatatattctgtatctgcactgtctcctatagtagccactagacatgcacagctattgagtgattgaaatgtggctggtgcaactaaagaactgatttgttaatttattgggaattttaattaatttaaatatatatagccatgtgtggctggtatcgactacatggacagtgcagctctaggaatgctgtgattcccatgtctcattctcacagctgctgggtggcactggcagttgacagccctcaagagagtcctctggaaatttctgtcagccaaagaaagccccttggcccagggtcacacttctttctgggacagcccacattcagtgactggtctgggcaggatataatggtctggccccctcatcccaatttggaacagctctgaagggatattctaacttcagaactccttatgggactggcaaggcttctattgcaactgtatcccagttctgtttctcccctgccttgtgttcttcctgcacccctcacagatgttgaccccaagagcatgccccagtaactggctgcatgtgaatgtctgtctcagagttggcttcttgggagcctgatttatgacactgtccctggcctcccacccaattctgcacatctcagatataaactgttaaaacaagaaagcaaatgcattgttaattttttcataacttgcattttacatcagcctgggcccatatcacaccgggaaaaggaaataaagtcatctgaataaaggatacatttctgcaagaagttctctgtccaaggagtcagtagaaggaaacactatgaatgacactgtattctaaattttgtcactgtcactttctcttccccccacaaggtcattttcttaattcaacaaacactgactgtgcatgcacctcctatattctagaccaacattagggttctaggtgcacagagatgacaaatgcagtatggttcttgttctcagtggctcattgtgtgggtgcagaaggagatgttcaggaggcattagataatccagtgccaaaagtgccacatttaaggtaccagggtacactgaagatatgcaggaggaggagggactcttctgtggggatcaggaaactgtgactctcagactagttttgtatgggtcatgagttaaaaatgttttccaaattttatattgttgaaaaatactcaaaagtagaatcatatttcatgatacatggaaatcacatgaaattcaaatttcagtgtctatacagaaaatcttattggaccacagccatgctcattagtttacatatcatctatggctgctttcacacaccaccaccagggttgagtagttgcagcagaaagtgtataccacctgtaaggcagaaagtaagatatttactctctggccctctacaggaagtttgccgactcttgggttagtgcaatcaaggaggtctatctgtaaagagttgcctctgaactgggttttaaagcatgaaagggaattttccaggcagaaaaggaccagatgaaggtaactctggtagaagaaacagcatgtgcggaggcatacaggcaagaggcaggaggcaagaaaggaatagtatgcataaataataagtatttcaggctgggagaggtggcttacaccggtaatctcagagatttgggaggccaagataggaaggtcacttgaagctaggagttagagaccagactgggcaacaaagtgagaccccatcgataaaataaataaataaataaattagctgtttgggaggctgaagttagaggatcacttgagcccaggagttcaaggttgtagtaagctgtgaatgcaccactacattccagcttgggcagcagagggaaaccctatctcttacaaaaaaaaaaaaaaaatgttggtgcatttgggacattttgtttggagtgaggtaggaagcaagtatgaaaaactggattttcatgctaaggaatttattcttcatttcttaaacagtgaggagtcattgaagtgttttaagcagaggagtagtttggccagtttggggtttcaaggagatcattctggtggcccttacggaggaagctttggaggaggcgagaccaacgcagggagtatttcaacaatgaagacaccaagagcttgacgtggagtagcagcggtggggattccagttcctatgtgagctcaagaacccagagtgtaggaagttcattttgacagactggtgggatgaagccaggacatggggcgggaaaaggttaggaaaggaaagagtgaatcagaggcgggggttctgtgggtggacaggcagctggacaggcagcagcagaagcgatgtaggacgcagcttgggggacagctgaagggctttggggttacagcagcggaagtgacttgagcagaggagggactctggacatcatggacaatggggcactgggaagtgaggagctggcggcagggtgggcacaggatgatgacgatgataacagtaatgatgataatagcaataataacagtggaaggtcaaaggcagcttcctctgagatggccagatgagggagggggctagtgtccagctcactttcataaggtcgggctgtaagtggtgaaaagcaagctttgtgtggtagaaacagaggccagctgctgccagaggggaaaggaaggtggaggctgaggtgggatattttccaaacccaagaaccaaagtaaataggaaatggaatctttaatgctatttgagctcaaacaaaagatcaccacagctacttcagttgagttccagtgatccctttcacttggccaggaattagcgagaggcctccccagctgtgcatctctcctctaagccttcacctgagaatgagctgaggtttgaatgaggcctttatcctgagagttcagggggctgttctggctccctgatcaaattcaaacctctgttttgggagacagacatgggaaaaatatttacccctttcatgttgacacatggatatacagggcaattctgtcagaatctacacgaagccagagctgcattttaagccagtatcaggggccactgtttttggggttgcttaggtgaccgtgtttggggtcagttgcctgatatagagggagtgctaaacaggggcttgtacagaagatgacttggggagtttgagtccacttacccttctctacactgtgagaagcaataacattcttgttaaccagtagtatataacattatctcacttaatccttccagcaacagctctcttaagttaaaactaatattagccttattgtacggatggagaaactgataccaagaggaggctagaatagttgtgcaagtcagagtcagtgggaaaaccagattcaagctgagcaacaaaacagaagagactctgatcttgtatatcactggaggattgaggaattggaggagcatcttccagggaacgtctctgttgactgtggaccagaatgctcttcatctgtcctcctggctatctccttctcaactgtcatgtgtcctccccagggtggccttctctgatcactcaagccaaaggatatctcagcatcctgtacggttttttcaaggtactggatataattgtatttatttattaccatgccccctcatttattttgcttgttttcttcagtagaatataagctttgtgtagtccagggctgcgtctgtattgctcactcttaaatcctggtaccaactaaagtgcttggtgcacagtatgaatgatgcatattctgttgaatgaatgaccatttcagctccccaggaatggggcctggccaggaggctgggtttccttgggagcccgaggtggatagtgtccctttggtaggctagtttgaaaggcagcagggtagaaaatgacagctcaacttgtgaaagtaaagaagaaaatgtctcacttttccatttattttctgtatttcaatatggaagagtataactggagatgggtgatgcagttgtaagagaaatgaaccggtacctgttgtagtgttgaaaaacagaattagatgcggaggtgaatatttgttgtgtattagcagctgtgatggctatcggctttacagacttgatctaatttttccctcacaatgatgctgtaatgtaatgctctaatgctttttgcaagcttttccattttacaggtgataaaatagaggctcaaaaagggtaaatcagccaccatctgttcaacattcagacagatggtgaagatgagattctaatgcagttgtgtcaaacttcataactcttttcattagtgatatgagtgcaagaacttgagacagactgcctgggttcatattcctggtctgtcaattactggggtgtgtgattttaggaaaatttcttaccattttgtgccttagtttcctcatctaaaaaattaggataatactggtgcctatcttataaggttgtagggggactaaataggtcaatactgttcaagtaaaaaatctaaaacaatacctggcgctattgtatattattttatcatcatcatcatcatcatcatcatcatcatcaattatcttcctcctcctcatcatcattttattggactaaatactctgcttttggcttcctactttatgattaattttgtatgtcaatttgactgggtaaagtgatggctagatagccagtaagacattatttctgtgtgtttctataagggtgtttctagaagagatcggcatttgaattagtagactgagtaacaaagtttactcgcatcatgctggtgcgccccattcaatccattgagggcctgaataggacaagaaggcagaggaaaggcaaaatagttctctgcttgaactgggacgtcatcttttcttattactagacattagtgtttctagttcttggggctttggacttggacttagattattggcttccctggttctcaggccatcacatttggaatgaaactctatcgctggattccttgggccttcagcttatagatagcagatagtgggacttctcagcttccataatcatgtgagccaatccctaatccctcgtgagaaatatcttcctatatatttctatttatcctattaattctgtttttctgaagaacgctgactaatatactccttctaagctgaggttgtgcagaggctgtaactaggaaggggaaccatctaggaagatttgagtgaaagttccagttcatgggggccctggaagcagcaagaaatagatcatatctggttcttatgaaaattatctttttcctctgctgcttctttcagaggctaagaggttccatttcaggtttcctgagtttctgcacagtgattgtgacctttctttcctttcatctttcacttctggtagaaagggagagtaacgagatgaagactttattaggaaatgaacacagcaaagtaacactacttggccatttgagatagcacattggcaagagtgtcagggatgctgctaaggatggtgcaaggccaggctggactcagaccctgagctcagacacaggagtctcagggtgatcttttagaagctccagggtccctctaggggtagtagagaagacagaaggagctatgtgacggagggaattcctaggcatgtatctgaaaggtgtctttgaaaaagtaataatttgtaccaactgagagcatcatggatgttccatgactatcaacacaggaatgtttttctattaatggactggactggtatgttttccatttggaggataacccaggggttccacagtgagctaatcattcttgagaggttgggatatatttctttgattttgccccaaagaagaggatgtttttaggagtcttgagagcccgtgcatctatcactgcaagctcttttcgttctaggatgctcagttctctctttaacttgacccccattggggctgcccccccatatcagaaatgtagacagagctaggtccctactaggctgtaagtaccatgaccaaaggagccatggctctagatctggccaaagatgatttgggaagtgtaattatctcttggctttctcagctaacttcggactctgtgcttctctaagctcaggatgtcctaaacccatcttctctggagaaatcaggtagacaagagatgagaggactctggtctccctacaagtttccttggcctctcccagaaccctcaaaaacccagaatgtgagttccagtgtaatccatcagtgcagaaaagaatgtgtgtggtttgtttaagaagaagcacaccctatgtggaaacacacatctgctgggtttttggtgggatgtgctctgctcagcctagagagtcaggcagtggagaatgtgtctgcccataggtggcagtacccaggtgagttctacagaaactagaatgcaatgaggtcctaaacttacagcaaatcaataaaaatcctaagtaggccctgatctatctatgaaaatatctccctcccctaatttccactctttcacctaactggggacaagggaagtaaaaactccttaggaaaatgggagaaattttggcactatattctagtataaatggttaattttctgaagttcaaaaaattggttaaaggtcataaaagaagaagaggattcatttgcttgtttaataacttactaaacaacatctttggcaagaacttatgctcagttaagggaaataacaacagagtctcaatgctagctttgagtttggagtttgctctgaaagataatacttcctgttgcctctttattgttatatcacaagtgtataacaaagtggttgaacttgattaggatgtttatatagctgattacaaaaaaaaggaaatggacatttattgagtgtttactatgtgcccaacactttctcatctaataaatattgtagtgtaatgctggtcacactcaaacactcagtggattgtagctgtcaatccactgattattggattgacagtaattgataaattactggattgacaatccactgatcattggatggacaactacaagccaaaaaatgcctggagccaccagaagctggaagaggtgatgagttttctcccaaaagccgttagaaggagcatggttctgcagaccccttgatttcaaacttctgacttccagactagtgaggaaataaatttttgttgttttaagccaccaattttatagtagttttttgtggcaggcctagaaaagtagtacaaccacctaatataagtatgaccttaaacttatcctccctcagcttggattccctgtatcagaaaattggaaaaatactaagggttgttgtaaaggttccacaagaaacacattggaattattgctcatagaatgggaactggagataaaggagattaattaaacaattattgtctttgcctgaaccagtgacaataccatgctaggaactatatctaaggttcaaagactgtgtgggatccaaattttgccacttaatgtctgtgatcctgggaatcttaggtgggtgtaagtaaactgtgacagaatttatctatgaggataaaaatggtgctggcttattgagtggttgtgagctttgaatagataatgcaaacacaatcagtccttctctcgtgtttattttgaaaatgggatttgttccaaagtaattgatatattagagaataatctgagcataatgtgaattctgtgtctgcttatattgaatttcatccacaagaaacactaggtgaatacagaaaattataacccaatgaactgagctgtgtaggaatacagaaaacacacgttgatatggtttggctccgtgtccccacccaaatctcatgtagaattgtaatcctcagtgttggaggggaggggtcgggtgagaggtgtggatcatggaggcagacttcctccttgctgttctcataatagtgagtgagttctcacgagatctggttaacaatgccctttgtgctctctctcctccaccatgtaaagaggtacctacttctccttctccttctaccatgattgtaagtttcctgaggcctccccagccatgcttcctggagagcctatggaactgtgagccaattaaacttattttgtttataaattacccagtctcaggtagttctttatagcaatgcgaaaatggactaatatgcacatgtacacatctcaaacatctaccatctcctcagccacatgtgttaagagtcacattcatccactcttagtgttacaaccttccatctgatttcagacgactctccttcataacaactgacaagctgcaacccaatgcccaggaaacttatttcgcaagtaatcctcagatctatttaaaggtaaagtgccatatttatggtgatatttatgtatgtctgaccctggaagcactgactggaatccctgcttccatctccacatgaccttcttccttggctctctgtgtctcaaatctctctcttctctctcttttaaaatgacctcatctccagatttataacttagttacatttgcagagactctatttccaaataaggtcgcattcactggtaccagggtttgtatacaggacacatatttttgggggggacgtccttcaacccagtacagtggtatgatggccagttgtaccttggtcctttgaaaagaagcacattgctatttctgctagaccataaagccacccagcatttgaagtgcagagacatatactccattccctacagatacagtaagattttaaaatactgaagctgataagctctatctttggcagaacttagttttgcatccttctgccaattgccttcccccactcttgggggatatctatagaggatcacttcagtatctaagtggaaagctttatgggaagaggatctataggttcttctaggtgctaggaagagctttgtgttgcaggtgagcacacctggggcctgtagatgtgcttgggggatagaattcaagtctttctgaagcagaccttccttctggactcagggatgaaactcttgcagcctctagtcaggacaccaaattacctagatcagtgcttctctgactttaatgtatgaaagaataacctggaatatttgttaaaatacagaatcctggactttacctgcagagattctcctttagtaggtctgagctgggcccaagattttgcatttctaacaaagttttaggtgatgcttttgccactgattaggagaaccactatctgagcaacactgatctaggcggattgtacaaaaagccatgtgggtcagtctttgtatgtatcatagtgaaaaatggtacaaaaagagcagttcaaagtatttaaaagtaattcttatttggactcttgcttcttaagaaacattaaaaaggattgaatttataagctagagcaatagctctcaaaaacttttctgtgctttcccaattctttcacccctatggcagaacagatttttttaattcaaatcctgaactcttcctcattaagctctggactttcctctttttctgcctcttgagtcctctgactctgattctcaaaattctagaatctaagttgttaaagaaaaaattctcccagaggcagaagtgaagggtggagctggcaaggcagataacactcccaagttgataaatcttgtatctcccaaagttattaatatttcacatctaaactccaaagggaaacctcactgatccaaagtgacctgcaaccactcaagataatgtttcttttttaaataatttaactttttgtgacagaaaagcaagggcaagtgtgtctttagtagctccattaacctataattttccctataatgccactgagattggaagtgttgttactttaaaaaaaagtctacttgagacaaacttgttgattatattatcagaatttctttatacaggctgatttttggtcttctgcagaaagtggtatgttaaatttttccttataattgtgttttcatcaaatcctttgtacatttagaactatttgccttatgtaacatgctgctatgttgtttgcagcataaacattttgggttgctaaaaagatggatttatatttacccattttcatctgtcacttatgtgagggattagtctataaatattatttttaaagcaatagaactcttttctcaaagtgaatctaaagcaaaaccccaatatataaaacattagctgcttagacctagaggagatgggtctggtccagcagttttcaaccaggctctgcaaataaataaataaataaataaaccccatggatcacaatttgagtaaatattttccaggctatccttaggatagtacatagaaaatgggttagggctgtagggcttccctagaacctgggttgagagggttgtgaggtctgtggcctggtagagaggcactttcaacaaattagcgttattgtgcttccttcagacaatgcttcccccaaaatgcatatggttaattgggattatgcactctgatagtgattgaaaaaatctctccatccagtctatggttagtgatgatcccagatacaggtgaaagaggacaggagcccagctacaggaaaagtcatcaggtcaaggaaattcatgatgtatgcacagagtaattattaagatatttttctgatatttcatatctctttccttctccttttttctacctccaccgcctcctttggtgggacttactagagtatggagtgagaattagagatgaaatgtgtccctctcgcagaatccgcagaatctgcttagctggaagttagcccctggagggcagcaacttgtctgacctgctctcggctacatccctagcacctaggatcgttccttggtgggtgcatgagtgggtgactgactagtgggtgactagtccttgacagagtgggtgtcatggactaattggagagacagatatgaacaaatacttttgaaatgatatgatacatgatgacatagatataccctgactcctaatgaagcacaagagaaggatggatgaaacctatgtgtggaaattagaccagggaaagtatcacgaaggacagatgttattacctaggactctttccccatctctgagttggccatgcacaggggtaaatgggacagctggatgctgcaactggtggaggaaggctaacacagagttgcatggtgttattaaatgtcccagtttccagtctgagagtcaggattagtctcatttaagaaacatgatctggccggatgctgcagtggctcacacctgtaatcccagcaatttgggagggcgaggtgggtggatcacttgaggccaggagttcaagaccaggctggccaacatgatgaaaccccatctccactaaaaataagaaaattagccaggtgtggtggcacacacctgtaatcccagttactctggaggctgaggtagaagaatcgcttgaaccctgggaggtggaggttgcagtgagctgagatcacaccactgcactccagcctgagtgacagagtgagaccctgtctcaaaaaaaaaaattatccttgtgacacaggtatgatacttcctttgttattggttgagtaatcgatagagttgaatagtatgttcattttaggtcactggggtctggcaggcaataagtggtctaatgggttgctggctcctttttgctgatccactaaggcagtgttgttacaggatttttcaatgaaaaaaagaatccaatgggaggaaggtcactgaagctatacctgctttgtttcatgggacaaatattatgccttgccttacccaggaattctaatatgcactcctatcttgtggatcacatctaaaagtagaagtcactgtattttttttccttatgaaccatcttcaagaagatttagttgagctttacctctgaaaagaatcaacatttttcaattcccaaatataaaatttcatttgaaacttccatgtgcttttttgaatgtaccccacccctgaaaacctgctcgagaggccagtgcacccctctagatagggattattgggtgagatgatggaaataaaaaacgaaaatgggttctttttctcagatagctactgtcttactcaaaaggagattaaaagtaaattaagaaaaaataaaagtaacttcaagtataaaaccattaagaacaatgcttaaaggaattgcaggaacaaaatcaaacaaagcaaaacagaaatgcctacaaaaaagagctgtaaatattagtctcaaggaaaaaataagagcaaaagttatatatattctctgtatatatatatgtatatgtatagtatatatatatgtatatgtatatgtatagtatatgtatatatttctatagactaatatattacacatatatacatatatagactatatgtatacacacaaatacaatatacacacatacacatgtacacacactaaggtctactaaaacacacacaaggcttcctatgcacctgtctgtgtctccctgcccaaggactttacctggccccttcagcagtgtgaggttactgaagttcactctccaggagctctataaccagtgatggacaagagtttctggaaaaatatccagcttcccatctctccatgggagaactctagggtatgttcagcattttttagtgggccccagtgggatccagctccaagtgctcacagggatagcaggtatattataccacccttttgctggctttcttcacttccacactttttcactctgctgctctggatccagaataatcatttctcacctaaatcctcaggggctgcttttgggagaattcagactaaggcagtacaccatagacacacctttcaagtttgtcaaaaatttattcaggtattttaaaaaaatgatgcagttcaaagagatacttctatttctttatctagatatatccttcttatttatattaatgttattagatttatctacatctctattcagtgctattgaaataaaataattgaaaataatttctatgctaaattcccatttgtaattatttataactttcaagagactttgagtccaatagatttttagtcactttatgtaaaatctcacttttttttcttttaaattttatttggcagaagacttggcctgtcccatatggtgagtgcatgtgaagtcccttggtggaaagtgattctttatatttgttttcctgaaaatttattgtcagaacattgttttggaatatgtgtaattcctctagggggttaaatgtgggtggtgagctgtgtagagaaatattacttatgacccatcctgggcagtgatattctcttacatatttagtctggctttgagtacctagttgatgttaaacaaatgctaattaataataacctaatagaaaatggatttagggcaaacaaatgcaatgcctaatgacatcctagatttttcaaacaacattcatcacatttattttagtcttctcaaactgaagccattatttcaagtcagttctgcagaaaagaggaggttaggtttgagtgtgttttttttttttcccagaatattccattctgtaggtgcctgtaattcctgggctgagatgaggtagctgtgtgcagtggggatgtataggatgagctgtaagtttcctctataagcctgaggttctttcttctccaaagaggacactcactgaaatttagtgcatcatccaggaaactgtgttattccaaaagaagataaaagttttatttaattaatagcatggctgaaaccacagactcccccatttataacctggattggcgccaagatcaggatcaataagaatgcaaatgtggtgttaacaccttcttcctctcaagaactgttttatccctcacttatccccattcttccatagagaccatctagagttagttattcatgttctggacccacacgctttccaacttttcttcctcattctggacctgccatatctttcagccacggttcgtccaagatgaacaaataaacacgtgatgaaatattattccaccttaaaagtgaagggagtcctactgtatgtaggatgaacatggataaacctggaggacattaatctaagtgaataagctagtcacagaatgacaagtattacgtgattccacttacatgaggtatacaaaatagtcagacacacagagagtaaatagtggttgccaaaacctggagggagggggaaatcggggagttgctattcaatcagctttaagttatagttttgaaagatacttctagagattttcctgtacaacactatgtttataattaacattgcattgtacacttaaaattttaagcagatctcatgttaagtgttcttacacaataaaaaataagaataattaagaagacatatttaggtttccatttctaccacgttcttctctgagcttcagtttacttctctggaagtagtgataataccaacctagtgtcattatgagaactaaatgtgataatgtttattggatgtctggcacgtcagtgacagaaaatggatgccagttttatgcccattagagaggtgtgcaaggcttagtgtaagcaaaggctctagagctgaattctgcctttgttacttgtgtggttttgaggaagtcttttaatctcttgctctttgactcagtttccccatcagttaaataggggcaataatattatctaaaatagagggttattttgagaattaaataaggcagtgtgtgtaaagtgttctatggatgtttgccatattattattattcgtttcctagggaaatgagtagtccttcttcattatctcttaatacagttctattattctgtgattctcccttcctatgtaggaaaaatgggttctcattgctaaaacttactaaggaaaatgctgatctcccaaaatagctattgagcagtaattttcaaaatacatagtaaacccaagctatacatgaaaggctcttaaactaggtcattgccgcgggctgcttagagagggtgccactggggtgatttatgtctggggggattattaattaaacaagagggtctgtgtttttgaaaaatgcctctgccacagaagaactgtgcctgaagagacataaaggaagagatgtgattagagtgtatctgtatctctctctatctctatatatattcaaaagattatgcattaaacatatttttttttccctgcatttaatgctttcaaagttttcatacatctctgtcctgagtttggactgctttggcaaactcgctgccttaaaggaaatgatatgtgcacatgaaattgctgtgtcaataagagatcggttcttgtttctgaggaacagatgaagatattggtgtgtgcgatatgtgtgtgccagttctagcagtgtttgtttaaaggcatatgaccacctggtatttttctgtatcagatttatttggagaaacttttttttttcagatggagtctcgctctgtcacccaagctggagtgcagtggcgcgattttggctcactgcaacctctgcttcccggattcaagcgattctcccacctcagcctgccaagtagctgggactacaggcatgggctaccatgcctggctaatttttgtatttttattagagatggagtttcgccatgctggccaggctagtcttgaactcctgacctcaggtgatccaactgccttggcctcccaaagtactgggattataggtgtgagccaccatacctggcatattttggggaacttgacaaggacagggacttggaggttcaccttcagtaggtgaaagtctcttgtaagaatgttgaaggttttttttgtttgttttctttttttttttttttttgaaaaattattgtcaaggactctccctgcattccttccatcctctttctcagtgacctcttctttgtcattgcattcttgggttttcttttacttcattaccctaaaaaattatccttcttaattttgtcctctatttgatgaaaatatctttgttgatttttttctggttataaagcacaggacaatggaacagaataggaaacgcaaaaataaagctgcacacctatagctatctgatccttgacaaggctgaaaaaaaaaaaaagcaatgggaaagggctccctattcaattaatggtgtgtgataacctgcctagccatatgtaggatgaaactggatgcccaactttcaccatatacaaaaattaactcacaattaaatattttaatgtaagacctcaaacagtaagaatcctagaagaaaacctaggaaatggtattctggacatcaaccttgggaaagaatttatgagtaagtcctcaaaagcaattgcaacaaaaaacagacttgacaagtggaaactaaaccaaagagcttctatacagtaaaagaaactatcaacagggtaaacagatatgctacagaataggagaaaagattcacaaacgatgcagctggaaaaggtctaatatccagaatgtataagagaaacaaacaattcaataaacgaaaagcaaataaccccattaaaaactgagcaaaagatatgaacagacacttctcaaaagaaggtatacaagcagccaacaaacatgaaaaaaatgctccacatcattaatcatcagagaaatgcaaatcaaaaccacaatgaaataccatctcacaccagttagaatggctactattaaaagtcaaaacaacaatagcaacaacaacaacagatgctggggaggctgtggagaaatggtagcacttacacattgttggtgggagagtaaatgagtttaaccactgtggaaagcaatttggagatttctcagagaacttaaaatggaagtaccatttgactcagcaatcccattactgggtatattcccaaagagaaataaaacattttgccaaaaagacacatgcactcgtacgttcatcatagtattacccataatagcaaagacacgcagtctatctaggtgaccataaatggtgtattggactatctccttgttggtcaacctaaaataaaaaccttttctgttctcaaaaaacaaacaaacaaacaaacaaaaaaaaagttgcacatatacaccatggaatactatgtagccataaaaagaatgaaatcatgtcctttgcagcaacataaatgcagctagaggccattatcctaaactaattaatgcaagatcagaaaaccaaatactgcatgttctcacttgtaagtgggaaattagcactgggtacacatggacataaagatgaaaacaagagacactggggactacggagcaggtagagagagcgggggacaagggcttcaaatgatctattgggtactatgctcactacccgggtgacaggatcatttgtacctcaaacctcagcaccatgcaatatacccatgtagcaaacctgcatatgtaacctctggatctaaaataaaaagttgaaattatttaaaagggcataattgtaaaaattcaagtaatacgggtatgtaaaaataatcacatctaagagcaaaatgccctattaatattttgggattcagccttccagattttttctgtgcctgcatatacatgctcacatacatgaagtgttttgtaaccggactatattattcatggtacaacattaatatagctctgtgtctatttgtctttaaatacagctctattgcatttgtttttaaaagctgcataatattttttaaatgtagtaattcatttaccagttctataggtaggaccccaggtttttatcaactttgcttaacaaccctgattcatgtatgtaatatctttacacaattgcctggtcattgccttagaatgaagtcctagaaggttaatggctgaagttaggtatatgaacatttagttttgatgcatattgataaatttttctccagaaagattgttcaaggccaaattctcacaatagtttacgagtgcatagttctccatgtccccaacaacaggggataacattgatctttatactctttgacaatttgatgggcacaaaaagacatattgatgtttaaatatgtatttctttgaatatctgaggttgagcatctttttcctctgtatattatatcccattgtatataccttttgagaattgcttgttcatgttctttcccatgttttccattggaattttcattttaagattaatttgtatgatctgcattgattgagaatattaaccatttttatgtcatatattgtgtaaagattactccaagttttatttaacactgtatgtatctttgattacagtgtttttgtccatatgaagttttattttttatgaataaatttgttaattatttcctttaagatttttggccttgatgacaagctaataatggccatcttcactccataatggtaaaattaaatatacacaaatttgatattacacatatagggaaaatataaagtttacattcataagtaatgtgtgaaggagaagcatcttgagttcagcagctgggaagatattttaatatttcaaggtttggggtgatagtatcagttacctatgtgattgccagagcaagtacgagtgtcagagaaagtactctcaaccttaggatgcattaatgaggtgcagaggctggagggtgagggtaagagttcaattttattctggtgatttgggacaccgtctatatttagatatggtggagaacttcaaaaattaggttatgtgagacttgattgaaagaaacagaggacttttccagaaaataaattactctttggaaacatgataatcacttttaaattttttttgaaaaatttttatgtgaaacacagatcagattgattctaaatttcctccagggataaaatcaatgtgtctaagatatagagagataggcttctatgcaatctaaggtagacttttctaacagcagaggtcccactaggctgggttgggtgttgtcagtcctttgtcactgggtgtatgtaagtaaagattgaattgcctctaagataggttacaacttcatcatctgtcacctagattggtttaaaaaacaagccttttaatgggattccctttctccagttcacccttcttcaaacctatcctctatacagttatcagacagatacagttaaaaagcaaaactacttcttccacttgtcttcctgaaattattcaatggtttttcataaatttcaatccaaacagcctaatcatgtctccaaagcctcctgtgaaccactgatggttttcccttatctccccagttcactatttattctcctgcaacaataaactatctataggtcatcctgtacaccatgttgtttcttatcttgatgctgggatgcactgctttgcttctttacctggctaatttctatttttcatttaagtgttggcattaaacatttaagttccctctcctccaggactttctccttaatcactacccctccattaaaagaagggttagtatcaacatctccagtgtggtatgtagtttgaaagggatattctatatgcttaattgttttattacacctaataaaaacaaaaggagaaaatatttatacacctattcaatgtctgtttattgagaacctactaaatgctatatgctgtgtaaagtgtattttatatgatttttaattctcccaacagttctatgaagtggtcattgttattatccacattttataggtgaggagatagaggtttagtaaaagtaagaaacttggtcagttaggaccatatagctaataagtagtggatacagttttcaaatctaagacttttcaacctactcttcctccctctctcttttgtctttcataaacattgcccctaacaactgttttgcatgtctgtctgtgttcgttcttaagaggacctgaaatgccgcaattggtaccaatactgtgtgaaacagtaagaggtaagaagttttgagcctgggttactcatcaccaagctgtcaaggaggtgcacatgtcaaatggaaaaaggggtggggaaggggtgtagtccctggaacaagacgatgctctagtcactcacagtctcactggtggtaacctgggaacatactctgtatggtggatcattcttgctggtgtaataaatcaggcatttaaaagttgtgggaggaacagtgtctacaaaaatgtggaggggaaaaagcatctcaaagggtggggctttgaatgggaagagaagtggcctgagagtatatacagatttccggaaatggtcagggagctgactcataggtgggaattgaacaatgagaacacttggatacaagaaggggaacatcacacaccggggcctgttgtggggtggggggagatgggagggatagcattaggagatatacctaatgtaaatgacgagttaatgggtgcagcacaccaccatggcacatgtatatatatatgtaacaaacctgcacgttgtgcacatgtaccctagaacttaaagtataaaaaaaaatcagagatgaagacgtctgggatagaggcatgtaggtgaatacaaggcagtgggcacaaagttgaatatttttgcatcacatgccagtgttcacatttgttaatgcattcaccatgagataagctctaagcagccaagtagacaaaacaacttgaccagttcgcatcagccagccttcatcactggccatcccagaactggcatagatgtgaataagggatcatggtggcacagatggaggctacacattggcttaacggtgtggactttcagttattaaggctgatctggctactgccacctctgaatgcccaacctaccggcaaccaagatgaacactgaggacatattatatcattatctatcatggaacctaacaggcttctttgtgcaagtgtccccatgaccaggagacccactggtcatatcacataccacagtatccagaatcagtgatcgtatttcacttcttacatcctccagagactacagttcatcctcaagggacagatatttattttgcgtatggttttgactttttagtgtacagagcctcggtcagcaccattatcttggagattagggaatgtctcatccatggtcatggtgttattttctccatgaaactgagacctacaaaggtttcataacttgttcaaggttgcacatccataaaggctgagaactgcaatttcaactcagatcttgggtctccaaagcccattcttgctctaccctagcagggccagtatagttttctgcagaaggtacattgactcaggtccagggtacttgatttggccactgtgtaagtaaacctgaacctgaagaccctcataaatcctccttctgagacacaggggtatcttgggaaaagcctccatagatgtttagttcaaagcaaaacatgaaaataaaggaacatccactttcactacatcatgaatttgaatttcaattgaattcaattgtgatgttggtgactttttcttcaactgcttcatgggggtttgtctttaagttttaggccagagatgggtgattaggtggaaaaatctgtaccagcgccaggcttggtccagctcccaagcttctaatcacctctttcaggcccaatccttatctgagaaatgaagttacaatttaaacagagtcaggtgtgtgtgtgtgtgtgtgtgtgtgtgtgtgtgtatcaacaaatctcacttcttgtcttttctttctaacctctgatgcttatgtcttagaaacagccttctgtgctgggtccttttgggtcatctgccttgagttcatcttgtgttaggcttgtattagagggcactctttttatggtgacagaagcccagcttaaactgtcatagaatttaccagcctatataagtaaatattcaactagattcagagccagtaggaatgagagtcttgaatgccaccaggaattcatttcttcatctctcttctctgcttctttcagcctgtcagctttattcttttaagactggcttcctacatttagttggaattacatttcttgatagttcttatgccttacaacttttatcttcatttttttctccgattttcatttgaaagatctcaaggacaggttctgattgagtagctttggctaagtgtccatcctaggaccaatgaaatgtggtctgatgggtggaggactttgattatgctctccctgcaatgcgatagtgggagtgtgaggagtaggaactctccaaaataaggaggatggtattgccattccagaagaaaggatactgaacagacaaaaccatgacacctatgatggtgacctgccataggtaagctgaatcaataatgccaggatcacctgctaaaataattattatttttttcttctcaaggaaacattaattttggagcatggttaatattgtcaatgatgtcttgctcacctttgtacttttcacaatgattaacatagtgccttaaacagaagaaaaaaataggaagagaaaaaacaggacaaatgatggatttctctttggggacaatgacatttattctagccattaaccccttattggacatcttcaggtgtttcttggttgcacttgctcccctttgctcaatccagaaaacacaaagaagccttttgcaggctattttagccgataggtctcagaagttgcctatgcactgcatcatgggtaaaatttgggttaaagataattgtaaatacggtattgatatcaactgatgttttcccaacattgcaataatgcttgttttgtttgttggagagtttattactttttgatcaatagaatgtgagatttgtgggtgaaattagcatagtgaataacaattaggcaaaaaatcaatgggattcagacaaatatgggacaattttctctctctgtctctctctctgtctctctctctgacacacacacacacacacatacacacacacactttaaaaactgtaaggcatcttatttacaattccaaagctctaggtggggatgggagtatatatggttcccatgaactagaaacaaataggtaccaagaaaccgtttgcagattctgttttcaggacacttaagatctttgtatgctgaaaaacctggaacatcaatatccattaattccttttgtactctcttcatttttagtttaattaagagtcactgaatcccttatctttatcacctctcgcctgggtgctgtggctaagaggtaaagcagatagaactctagttctcccatagtctcacttttatttcttttcttctttcaacattatttcattggtggccaaagcaaagcatttacatactatgccattgaatcataggcaatgaaattaagagagaccccagcaatcacgattcaaatcactcctaagaatgggacagaaatccctgaaactagagtttgtcctcaagcattcacttgcgtatttctaatgacagggaactcattacctcccaaggcaatccattgtaatgtggcacagctctgatggctagaatgtgttcccttatattatatggaaaactgttccctgaacattctcttattggtcctggttgtcctccagagtcaaaaaaaacaaaagaggaaaaaagaaaactgtgattgatttattgccttgtgagattataggccatttcctgtatttttttctttaagaaaaatggtcaaggccaactattatatcagtttttgaacatcactgtattctaggcactggagtaagaacttttcatacatgcatcatctcattcactcttacaccttagcacagaaagtaaaaatatgtacagaactcaaatacttttcagtatctgcatttacattgaagtatcaggatttcctctggctgttggatgtgaacagccttgaagggaaccacactgaaacatgttccatttcccttcccttctgcttgttggacagaagaagccacaggagtttggagaatgggaagaaaaacttccatttattttacagatttatttttctctggagatcagattaatgccatgattactgctctgtgcaccttgtatgtcctcaaagagatgaccccacatttctgtgaatgtccaatctgatgtgtgagccgtctttgactctttgttgaaagatggcaacctatctgcaaaggagaaccctctgatccagcatccacatcccgagtatccatccattctgagtggagggcattttcaagcttcctcaagaaacgcatgttgactgtgagctccttaaaaaccatgtttcttcttgtctcctgagcctctggaaaatgtggttcggataagttactaagtatatatttgttggattaagtacgatgattgggatataatacagttctcagctcttacattttgtggtgtgtctaagaattccctgagaacatcagtgaagtgtatttacagcattggttcaactcctggtggactctaacatctgtgtatcatggtatttgaggattccatggggttcgttgccatgtctgagaatcctaactatatatcatcctatctgataattccttatggaatatctctgtagctgagaatttccttccactgcatgcctgctcagaaaacagtgtttagaataatggtcctgcttggctctgaattgggctggttaataatcattgctggggaaatcaatcaaatctatgatatcttattacttacactaatttaatcacagggaacggatcactgttccagttcaaagggcaaaaattgtgtgtgtgtggagggggggtgtatgggggagagagagagagaagagagagattgaagagcagagggtacgttaagcaaagaaggtagtgaaaccctggagggaatgacctaatctctacaacatatcatatgccatattcagctgaactttaatttgtacctgaaagcatgttacttttattccaattgtattctgagaattgtgttctgaataatttttgagatcagagaaggcaattgctaattccctaatcatacaaattaactgagtatgatttttagtaaaattgctcacatgtgattactgcagccaaccaagctggctccatcctaggcaaatgagtagatgacagccagccaggatggagaccatgaatatgcaggatcaatgatggtccagtctctccaggtttatgagttagtctgtgtcaatcttgtacattcccttttatcacctttctgtccaccctaatctcaaatgccacagcctccatgaagccttttctgaagaggcccccaatcaggtgagagctcttcctcttcggaatttcactctcattttgtggctccagagtgggtgctaattacgtggtctaccccatctttctttctattgagcaatgccactctcctggtccatggggattctggtggaggttttagccaaagaccccgctcttctggcccagactggccagtaaaaaacccatgttcttggacacagaggttggtccgggatgagctgatcagaatcctcttttgattatcctgttgagtttggaggaggagacactcttgagattgcaaatagcaaagaccaaaaagctacagttttcatcctggcatccctcctgtttttgtatggctctgccttagtcctttggtcctgttttgtaaaatttcctatcttctcactggttctaatatagagatgatatttttttttttctcaagacccaagcctgattgattggcagagactgctgctggagtaatgtgttaagaaagagaccgggtcatgcctagggtcaaggtaatatgtagggtcagcaggaagagattgtgatctattagttatgtcttacatgggcacaggagtggttgtaaacaaaccaggtgtttgccatcctttatctagtgacatatcctatttcttctcagtgattggtatgagtcctggatttgggcaacaacctatttctatcacttgtcaaatttgtcaccaggaaagccacagtggccacctcatgaaccaggtcaaccagacttttgcccttcagactttaacattaattctttgggtcctcgaaggctgaagtcagtcagaagaataaatgacgctacattctgacaaattcaaggagtgtgcagcataggctgggaggcccaagattgtaggcccagggcagtccatgcagcaaattcacttacattagctttccaattcaatgttcaattgattacttttgtgtaatcatggtccactggggattttgtatgatcatttgtgaccagagaccatgcatgcgttttttttgctattgcatctcctatgcctggtacacagtaagtgctcaataatgtgttgaatgagggaataaataaatcagcaaattaatgtacaaactctctagctcatatcagaagtcaaaactgattcagaattgatatttatggaatactatttgagctgaagtagaaggatctagaaaggatacattcagtttttatatttaggatgtagaaccaataggatttggtggtaaaaaaagataatgctaggagaaagggaagagggcaagaagtctcccagatttatgactggagcaatgagtggctggtagtggcattcattgagatgctcttccaaagcacctgtgttggccttgtcataagaacttctcatactctatttttattggctgagtatttctcttcctttcaagccaggtagtacattgagggaggcactgtgcctatcttgtatagaattgcattcccagaacctagttcagtgctgggacatagcaggtcagtaataaatactgagtaccacacgtgtgttggtaccaaatagccattgatgatgatgaaccacttaataagtatataatgacactgtatttccatttattatgacaggggcacatgttacctaaaagcaacttccagtcacttgtgaaaaggataaggtgcaaaccttgtttcacatagctcagaactgtcctctggtctagtgtagacctgccaatctaccatggtattaaaatgcaaattttgtatgagcttcaattactgaaagtctatatgaagtttatgaggcttaacccatagctggttcctgttcacagtcaaaggccaatgaatggtcaataaaagctgcaaacagctttccgttattcctgatggatttctctgtaagatgacagagtgtaacaatgatcaatagtggaacaaccatttctgaaggcctcttgtgtcagatagaatatattgatatgaaggagggcagcatcaagttttgttggtatgtcagcctatggttttgggtaaacagaggatagctcctctttaataaaataggatagattatgtttgagtccttccaatagaacctggcacatagttggggctcaacaaatgtgcctgagataatcatctcggaagagttggtttaagagagacttattgagttggttaaggggaacatattggtgagtattggagcccagggattagttgtcactatgtcctcctcctgtccaggaagaaaatggatggaagtggcattttctactaactgaatgatgaagatagcttctttttttgtatttgttacagaaatgcccagtgctgtctggtctagtctgattttaggaggatcagaattgaagatttatccaaggatgctgctatgtgatgaacagagaatgtgaggactgctattctaggagggcacgcagtatcatctgatgtacaaatgtttaatttctcagtgcctcaagattttttgcagacagtaatgattggggagcaagtaaacaatggcccatttatagatatgagaggtctggtcttcgctggtcttcgcaggtttagtaatcatgtgctgttaataatcctaacaacacagttacgatcatttagacagtggttctcagtcctggctgcacagtagaatcagctgggaatcttggaaagtacaaatgtgggagtcccattctagaataagagctctgtgggtgggactgggtatcagattttttttttttttaaagcttctcaggtgattgtaatgcacagccagggttgaaaaccatcaattggcccaatagagaaatagtgaaattcagcagacactgttattttctgactctattgaggtatcattgacaaataagaattgtatctatttacagtgtttcatgtgatgttttgatatacatatatatgaaataattactgtagtcaagttaattaacatatcaatcacctcacatagctaccgtgtgtatgtgtgtgtgcatgcatagtgagatcttctctcttagcaaatttcaagtatacaatgcagtataaattaactacagtcatcacgctgtacatcagatacctagagcttagtcattgtgtgtaactgaaactttgtaacctctgaccaatatctctccatttccttcaaccccagtccctggccaactactattctaccctctgcttctacgagtttgacttttttaggaaccacatataagtgagatgatgcagcgtttgtctttctgtgtctggcttatttcacttggcctaatgtcctccaggttcatccatgttgcgcaaacacttttttgatggagaaaaactgttttatttgatgactaactaggcagtgaattcctttaaatgggattggaaaatctttagaattagatattgttaactaaataataggtagctggactttggggtagctgatttcattgttgtctatgccctaggaagggaacaatataaaaattaatttgtcccttgtccagacactggttgcaatcattgcctaggattttcaaactttgaggaaggctgacgagcgtatggtgattaactggcatactatagatctattgagaatgcttcgaagtatgtagcttctcaaggaattctaccccagcaagacacaggggaaggctgtccttgggtgtgggaacaagaagttggacttaggagttaacacttcagatggtaattggaggggtagctttcaaagcctctcgtttttctgaatcaaaaagagaaatggttggtgggaggaaatggccctgtgctggttggcatacataggttaagagaaagaggagctcttgttgcatgtgactccgtggttaactttttatatggataattgttagtgaaaacccccatgggatgttagtagctatgacttgatgctgtggacagccagccatcacagataggttcctacagggctttgctgtgggatgaggatggctcaccaccctgtaactggctcttaaaagggagccacgtgtaacggctgatcaaagtagcaccaagaagggctgatatttatttgttaaagagagaactaaaattttccttgtcatttgtagaccacatttttttttaaaggcctgctggatctgagaatatattttttggctactggttttacttaatattattattaatgggtatgatgggaactaaacttgtttcattattttaagtaatcaactggcctataataaagagatattaccaagtaagtattattcaataaaggaaaggattgtttctattaaaaacatgagtctgtatatccatgatcttgtgtatgtgtctggggttatgcgtctttcaagactctcagaatgggtcagttcattcttctcgtttgactaatgagtctactgagacttgatgggagtatccagagagctattaaataatgtggaaattgagctgattcattttctttctttctttctttctttctttctttctttctttctttctttctttctttctttctctttctttcttttttcagacagggtctcacactgtaattcatgctggagtacagtggtgcaatcatggctcactgcagcctccaccttctgggttcaagcaatcctcccgcctcagcctcctgagtagctggaccacaggtgtgcattgccatacacagctaatttttaaaaagtatttttgatagaagcagagtctcaccatgttgcccaggctggtctcaaacttttggcctcaagtgattttcttgctttggcctcccaaagtgctgggattacagctgtgagccactgcgcccaacttcattccttttccctagaggattctttgcagggaggataagtgaaggaagaatcttgctgtgaagcagaacctctatgaggtcacacgatgatggctctctgcagtatgaacagagagagagagagagacgaaagggcaatcactgtccattctccctcccattgctcctgagacctcttctttacaatcaggcctccgtgctgctgccctccttgtgctgtgtctctttgtgtgagtggatgaagtgactgaaggcagatccagggagcagaaaagaagtcatgaaagggaggaccagagggtgtctagaagggcatctactagtcatttgatggcctgtgcgtatttggatagaatccagagaactattaaaagtgcttcccaagagagccagattgcctgggatcagatctctgttatgcctcttattagccatgtaatctcaactcttagttttcccatatgtataatgggatggtgacaacaatagtcaacctcatagggctattttgagcgtgaaatgagatattacttgaaagtgtttagaatagttccaggcacatagtaagggttcaacataagctagttattatggcttttatgagattagctgagaaattcaacatctatgacttcctaaggtggatggtcattcgttcgttcaacaaatatttgctgaatattactgtgtgtcaggtctcatgccaaatactcacaaatgaattacaaatggcctctctttgaaggagcaagaaggactggtttgttgtttatcccaggaatactccagcaagcttgtacaacttgccttattttgttgttgtagttgttgttttgctttgttttgctttaggcttttcacagcctgaagccatggtttttagtttctgtctctagtgataagtggaaatgggggatgagaaagggctttactggcccaaccagaaagagaaactaagaacccataagtgtattctctcccttggatacccctaaggggtagacaatcaaaaagaaagaacggcaaaagaacagtgtattcagcagcccaaatgcacatggaaacctctcatttttaaagaggatgaagccgtggaggccggagcttctctggggtctggtgtcatgatggtcacaccagcagtagcagcctgtgggtggggaggggacagaatgaccccaggcctttctctttcctgtaatctagatgtgaggcttgtgaagaaatttcctaaaagcagcctattgaactcaagttccccatctcagtctcagagaagtgggaaatagggcctcctttcacagactccaagggcaggaattttcgcctttctcatgcaacaagcagccagctccttcaggcctcatagaagtttcagctactgactgaggctggtttgggataagaaaaacatcctctgctgaggtctcatggggcctgggtcaatggctctgaactgcagggagcttcgtgggggcaggctgctgtggtcctagcttgctttagattgtaataattagagaatctatacttggcagaggtgagctggatcatggagataatttcgttcaatcctatcattttgcaaagataatcctttacaactagagaagaccaagttatccttattctctgcccagttctgttccttactcagcaaaaatctcttctctctactaatagttcataggtctttgtccaccaaaagtccataaggattctgcctgattcatttgcatatgactcatatgctaagagcttcgtaccaaaatgttaagtgtaacatatttgaactacactgtgatatttcatcaagagttgccaaactatagcatggaatatacaaaaatgttcacttcaagttattaaaaaatttgtcctttattacttaacgtaaagttggagtccattataggaatcatctctatcatcaccattgtacccatcatcatcctggtgatccccacggatcatcagcagcagcatctctgtcatcatcatcatcatcatcatcatcatcatcacaacagataacattgctagaccagtggttcttaaagtgtggtcctacatcaaaagcattagcattacttggaaagttgttagaaatgcaaaatcttagagcccattctagacttaataaatcagaaattctggagtcaggcccggaaatttttgctttaacaagccctccaggtgattgtgagttggagaaccattgtgctagactgtgccaagggcttttaacaccttatctcacttattccacagaataacccacagtgataagtaccattgttgtcttcattttaagaaaactgagacagagtgaagttgagtaacttgcccaaggttccacagcttgtggcatgaggcttagctagagcctgtaatgcatttactttgttgcacataatacattttcttctttttaatttaacttttaatttattttattttatttttgagacacagtttcactctgttgcccaggctagagtacagtggcatgatcttggcacactgcaacttctgcatcctgggttcaagcaattgtagggcctcagccacccgagtagctgtgattacaggtgtgcgccacaacacccggataatttttgtattattagtagagacagggtttcaccatgttgtccaagctggtctcgaactcctgacctcaagtgatccgcctgccttggcttcccaaagtgctgggattataggcgtgagccgtgcgcccagcctaatttaacttttaagttcagggatacatgtgcaggtttgagaacacaatatatttccagtgaagtcaatatctgtgactctgcttatcctaaccaattctatgaactacaaaaaagaagagtagtaaatcctttaacagccaatccctaacaatatcatggaattgcaatttatttttactcagcttcatcttatgcagtctataaccacaggcttgaggtggtgacatgccttcaaatcctgcttcatcttcccttgaagtaaagccaaagatgatttcctgggcagaatgtggccaatgaggtctgcagcagagagaacaggagtgggcagagggggatagggtgggaccagctgcaaaatacttcctgagtacagaaagaagggatgaaggagaaatgaggccagaagagaaaataagttaataagcagagaccactattcgatgaaacaaatactgtgatatccattgtactgacaaactaaaacctggggaggttacatgacacatgcgataccagtaacggggaaacagatgatctgggatttgacattggtgtttcgactcttaatccagtgcttattctactatagcgcaactggagcaactgaagatgaaaaccagccatatgaggttatgatgagacacatgtgggaacatatgcccttcttggagttcataaaattccaggagttgaatgaacccaccgaaattgaatgcaaagttatgatgtcgtggtgtatgtgtttattttatacttatatacacatgtgtatgtgtgtatttgtgtgtatatatgtacacacacaggtatatacacatatataaatctgtattagtcagtgctctccagagaaatagaaccaagaggttctatatatatattttttgtttgtttgtttgtttgtttgttttgttttctgaaacggtctcactctgtcactcaggctggagttcagtggcctgatcttggcctactgcagccttgaccttccaggctcaagcgaccctcctgtctcagcctcctgagtagtgcaccaccatgcctggctaatttttaaattttttcatagagatgaggtctcactatgtggcagagtgatagatctcattatgttgcccagtgggcttaagcaatcctcctgccttggcctcccaaagtgttggaattacagtcataagccaccacacccagcctgtaatgagattgacaataaggaattggcttatgcaattatggaggctgagaaatctcatggtctgccatctgcaaggtgaaaacccaggttagctgatgtgtagttctagtctgagtctgaaggcctggcaatcagcagaactgatggtgaaagctccagtccacgtccaaaggccttagaaccaggtgagctgatggtatgagttccagtctaagtgctgcagaagactgatatttggctcataaacagttgagtggagagagtgaattatcccttactctgtttgtttttgtgctatttgggcctctaatggattggatgaggcccacccacattggagagggcaacttgctttactcagaatactgattctcatccagaaatatcctcacagacattcccagaaataatgtttaaccaaattatctgggcaccctgtggcccagtcaagttaatgcataaaattaactatctttctctgtctagtggagagagagagagaaaaaaaaaagagagggagagaatgactttcctatttctattcccatatgggtcgtggtagattgcattattccaaagatggccgcttgcgcgcgcgctctctctctctctctctctctctctctctctctctctctctctctcccccccctccccctccccctccctttctccctccccctccacgcactccccatctccctctctgtcccttacaatctaatcagcagtcttcctacttagaggtggggtttgtgttgctttttccctaatttggacaagggttgattaaagctccaacaagcagataatggagaaaaatgatatcctgtggcttccacggctgggtcatcaaaaggatacagctccttttctctgcctacacacttgtccttggaaaccagccacagtgctgccgggaagcttaaatgagcctgtttggagggacgacaggagaggggctgagatctccccagtcgacagcgagcatcaactgcccctgtgtgagtgagcgtttgaatggtcccagcctccagccttcaagcctgagaccccagggatggtgcagcagaatcaagccatccttgctgtcccacttggactctgacctacagaatctgagagcacaatgaatggctgttttatgccactgaattttgaggtgatttattacacaaccctaataacaggagcactacttccaatctttttcccaccctgtagcccagacgttctttctaaaatgttactgtggccctttcatggctcagatcaaggctgttctgtggatccctattggccacaaggtaaaggtttgtgaaaggaagctctctgcctattttctcagtcttggaactttgactatatctggccgcaaccacaaaacaccaattcagacctatggagctgctttgggttccctgaagccattagtttcccaaacctgtgtctgagcaataaaacacttagtcatgaagcagttttcacaggtttacagcgagaaaggctgaaaaagtagaatttaatttttatggtaagattttcttttaggtaaatctattaagttattagaatggtttccatccccaaccttcttttttacttcctaaaattcacgtttttttctaatttttttggtgctaaaaatgtcctctccttaatgaaataatgggactaccttgtttcctgtctctgctcctgctgtttttctgttaaagtccttactaggcaaaataaaaagttggtcactaaatgctattccctcaattaaaaaaaaaaatcctgtacttgaaataaaagtctgggaaccactgacccacatagtgtagtctaaaccacttagcatggcattaaatccttgatgccatattagttaaattctgttctaattgtatgataattgggtccaccaacaatgtgattccacactatgcccctcaggtaagtgatgaatgtctgagaaaattgggtgcttggtggagcattatttctttgagaaatatgtctgaaggcacaaaccattgacttaggttaagttttaaaacactgcctcctctgaagttaggcgttgctagctcataaataattaatacaaaccatatagccactcagacatacatgtgtgcatacctacatcacacatgtcatcactcccacactcatattaacttcatacacccacactgatgttaaaatgcctgcacacccagacaaacatggcagctggagagatacagagttctgcaagtgatccagcgaggtgactaagctaagctgtgcttcccagttcccatccattcccatggagatccatcaatctccacgtatctgctttcaggagctcttttccccaaagtccttgaaataaatttgtagcctgatatttgagaatggccagtctgagttctacttacataactcacccatgcccttgacattcccccttggatttgtccatgcacagctgatccatcccctggaccaggacaaggctacagctcagaggccctctggtggagaaaatacttgtattttttttttttcctggacttgcagctatctggtcttgcttcagttaatcagtttcctgccacctagctgggataatagttcatcttgggtttgttgacctctgtctcttccagttgcctggtgtttggtgattcaaagggtgataaataaacaggattcataatcatagcatgcatgattaggaacactttctgaccatttcaatccaatttgcatttaggtctggttaacctgaggggcaggcatgttaatctttacacaatacggattgattactgacttctcaaatttttcctccttcagatgacaagccccagcagcctgaaatttgtcaatttaagatagcacccaaggagcacaacaaacctactttaggaaaaaaaattaacttggaataaatacattacttccgtgcagagcaagaacataaagttataccccagggacaggcaccacctataacctactgcacccctgcaatatcttggtgcctcattagatttattaatgaggctggcacatcactctacccagccctattgtttaataggatcggtggacattgaccagcacagatgataaatttgagagaggctctatcagcataaggtttgggactggggaagcagatggaaatgttttcccttgacctcataatcctttatgtgtcttccttgtgatgacattgtattatttaaagtgcacaggatctatagcacctccttggaaatgtctaggaatctggggatgagtctgtgacctccatggaaaatgttaggaattctatccagatgtgcaggtttctttgctctggcccatgcttaaccatggaactgcaaaaacaggaaagccttagaggtgtttgtgatatcataaggtacttgcatttttcaagagcataacttggactttacatgcctctaaccctaactggcatctcttatggtgcttagcaggtgcctacagaatgtttattaaatagatggactttggactgttcaggggcttgatgagttccttgctatcagttgagcaaaagtagtagaggatgttttattccaagaaggggaacctgggtggtctctgtgtgtgtgtgtttcttttctatttgcttttccctatcatattgaactcattaccttcatcggggctgttaggacagattcctgactattccccctctccattggaggtcacttctcatcttgcttccttgatttccacaagaggaagttaacattatcctgagtgtgactgtcctgtggcatttggagccattcttaaagtacaacactggattatttcatcacaagcatttgccaatgattataatcgagggatcatgacccctcagtctcttttacaatgcctctggagagagataacattcaaggaggattgcttgcttcaaggacctgtaatctacctcttcttccaagtattccaaattaaaaaaaaaaaaaaaagggaaatagagagctgagtacttggacattgtgctggttccctttagatctgcttccatggaatggtcctttgatagaatatattgaggttctgataagaaacagatctattaagttatagttaagtccattttaatgatactattaagtggtgtttattatagcataccttgtattctttataaagacttctgggagatatttttatctggtttcagtgccataaaaggttggctaattagcaaagagtaggacctttacctttatgagcttcataaactttcgtaagcgtttagtttgtgtgtgtgtgtatgtgggcatgtgcatgtgcttatttcaaaaaatttccaaagcaatgaaatgaaagagattttccctgaaagaggaactattattcatccttgaaggcctatcttaactatatggccttgagactttctcagtggctgctagggaggtagaaacttctgcctctgggccccgggaccactctgttctttaaagtcatcagttgcaatgtgcttggatttgtgtggccatggctgtcagccccactcacctgggagcttgtaaaagacaagacaaggccttctgggtagcccccagaacctcaaacacgggaaggtgcattgtcacttagacattttacctcagcctcttgatcttcactgacttgtggactctcaagtatgctttgtctatgtgtaattttgtaatagagcgttggaagagagactggcatttttggataaattaatctcttagtgaagaccttgtagttctatttattctttctagtgaaatgtgtgtgtgtgtgcgtgcatgcttgagaaggagagagagagagagaatttgatttattaatcaagacatgcttcagttactgaatgggaagaggaccaagagtctttgggcttataagttagatttgacccacacatttacaatgcttctgcttcaagaacaaggtgctcttttatattcttttcttaatgaatctgtgaccaggtcattctcatttttggattttagaacaggtctattcgagataaaaactgtgcccctgaggtttgctttctaaaacacaggtgtttcagatttttttttttttttttttttgctgatttggttttaattccgtcctttctttaaccacatcttttttcctttctaggagcaatacaaagttcagacacgttctgaggttgagttttggtgactttagcagaaagtcagaagaaagctgacaatttccttttcttcagtgatgtgcatggtttccaggcctttctctggacctatgattcactgccatggagtggaactttaacacccctagactgtggaagctcatccagctttcaacagtatcacctagaggcaatgaaaagcaatcagaatcacagaccaacctcatgccaagagaatcttcattcagttgtggtctgctttgtactgcttgagcatttggggtttgaaaaattaaggaaaagaatagggggaagccccaagatgaaaatactggttttcttgccaatgttttaaaagcagctcaagacttaaatttgagttgaaaatttcttatagcaaatgtgacttttgggcttctaaaaacaagtcatcctggttatgcctggttgttgaaagtctgcataattatgttatcttatggacatgtttgtatctcttcaaaattcatatgttgaagccctaactcagtgtaactatatttggagatagggacttaatgaaataacgaaagttaaatgaggtcataagaatggggccctgattcaataggattagtgtccttttaagaagagataaaagagagagctttccaccctgtcatcccccttccagctcccatgcagagcatgcacaacagaagagatcatgggagcacagagagagagggtggctgtctacttgtcaagaaaagaggtctcagaactcatcattttttatggctgcatagtattccatggtgtatacgtgccacattttcttaatccagtctatcattgttggacatttgggttggttcctcacttttgttgaatttaataaatttgaattttaaaatctaaaaaaagaaaagaaaagaaaataggtctcagaatgcaacccacattgctgccatgttgatactggacttctagcatctagcaatgtgagcaatacatttctgttgcttaagccatccagcctgtagtatttacagtaccccatgctgactaatacattaatcttagttagagaatctgctatttatagggcaataaatgtgtccaggcttggtaattagagagacgggggttaaagtcttgtctctgccatttgtttgctgtgaattttaggtgcattttcttgcttctgagattgtattccatcatatgtaaaatggagattttaataagaccttcagtgtaaagattaaatgagataatagataaaaatgcaaatataaatgagggactagcatagttgataatctgaccaataccatttatcgaatgtctgcctgagcatagtagtgctatcaggtttattttgatgtggccacctcccagaccctcacccccacccagaattggaggcaggagaattgaaatgggaaatatctttctgattacccttttcctcacaaattgtaaccaaaaggattttcaaaaatttcccctaaattgttatggtactaccttagggcaacatgctttatggtctagctgggttattacgaaaaatatatttaatttttttctccagatccctggagaaaggagatggtactttcaaacagaataagagaactttgaagagacttaacaaagggactagttccaaaagtatggtgtggatttaaggaaataacaagagatagtgcagtattctgaagtatccaatgaggagctgttaccaccccgggtctaaagggtcaaggggagggaccagccactagaagtagataggataactgtacgaatagggaggtttgactcgagctatgactagtagtggaagaacacaaccaacttaggggcaccctggccatgagggagctgaggaaacaaatattcaacttcactcttctatcttctgatctcttcctgtcctctcattggctgaacccaaccagaaaccatggacactctggttcatacactggttgatggacgccatatgtgttagtcccctggggaatacccagcaaactggagacagtggacagtctccactgaaattgggaggttaatgcaagctatccaggacaggagtcttctcaatacttctcaacttctcagtatatatatagagagagctctatatttgatttctccatatttgtttcttgatatgttaaaggaatatagaactatagtcaatgataattgtacatttaaaaataacagagtgtgattggattgtaacacacaggatacttgaggggatggatgtcccattcttaatgatgtgattattacatattgcatgcctgtatcagaacatctcatgtaccccataaatatatacacctgatgtgaacccacaaacattaaaaattacaaaaattacaaaataaaagaatatagaacattttctttgtttcccccaaacaattctcaagtttaatatttaccctggagtgatacatttctaccttggagcagaaggctgcaaggacacgtgatttaagagaagaatgtacagacacagtgtttgagaaatactttctgcattgcactgacttgtcctgttgactcatccatggctgtgggtcctttaatcatagttctctggggccatccatatggccatatctctttgtcactggagacaaaagactatttgggcatgatctccccctcctttttgaactttttttttttttttttttttttttgagatggagtctcacactgtcacccaggctggagtacagtggtgtgatcttggctcactgcaagctctgcctcccaggttcacgccattctcctgcctcagcctcccgagtagctgggactacaggtgcccgccaccatgcccggctaattttttgtatttttagtagagacggggtttcaccatgttagccaggatgttctcaatctcctgacctcgtgatccacccacctcggcctcccaaagtgctgggattacaggcgtgagccaccgcgcctggtccctttttaaacttttaaagtttcagataattatatatttacatgcagttgtgagaaataatataggaagatcccatgcattctttacccagtttcctcaatgatagcatattgtccaactacagtataaatcaccattgggatattgacaaaggtacaatccatttatcttattcattttttttagttttacttgtacttgtgtatatgtatacttagttctgtacaattttatcacgtgtgtaggtttgcatgtctatcatcatagtcaaaatacagaatagctcaatcactacaatgatttctttttagttattttaaaatgtacaattaagttattgactatagtcaccctgttgtgcaatcatgtatgtcttattcattctttttaacatttttgtaaccattaaccatttccccctctcccctcaccccccacttcccttcccagcctctggtaaccatccttctactctccatgcccacgagtaaactgttttgatttttagatcctacaaataagtgagaacatgtgatgtttgtctttctgttaaatgaaataatccaggtaccacaatgatctttcttttttgtggggtggcggggtggggtttcactggtcacccaacctggagtgcagtgccccattctgggctcactgcaacctccgcctgctgggttcaagtgattttccagcctcagcctcctgagtagctgggattataggtgcctgccaccaggcctggctaatttttgtatttttagtaaagacgggatttcgccatgttggccagactggtttctaactcctgacctcaggtgatctgcccgcctcggcctcccaaagacctgggattactggtgtgagccaccacaatgatcttgatgttcttctatcacatctatttctttcctaacgcaccccatttttcatccttaaccccccggcaactaccactatttctataattttgtcatttctagaatgatacatgaatagaattatacagtatgtaaccactaggattggcgttatttcactcagcgtgattctcaggaaattcatccaaattattgtctctatcaacagttcattcctttttagctgagtattattccatggtatggatgtaccactgtttaaccattcacccattgaaggccatctgggttctttccagctttttgctgttatgaagaaagctgttatgaatattcatgtacaggtttttatagaaacataaatttctatttttctgagataaatatttaagagcacaattgctgggatgtatggcaattttatgtttggatatataaataactgtcaaattattttccagagttactatgtcattttacatctgtaacagcagtgtatgaatgatcctgtgtctttgcatcctttccaaagatcaaagacaagcatttggtcttgtatcaagtttttgaattttttttactcattctgataggtatgcgtaatatatcactgtggttttagtttgcatttccctaatggctaataaagttgcatatctttaattgtgcttatatatcatttgtataccctcttcagtgaaatgtctgttcatgtcttttgccaatttttgaattgagtgttgttttttactcttttgataactctttgtatattctagatactaatcctttgtcagatacgtgatttgcaaatacattctttcagtcagtaccttgttttcctctcaatagaatatttcacagagcaaaagtttttaattttgatgaggtccaatttattattttcttttctggatcatgcttttggtgtcaaacctaagaactctacctaagaacactttccctaaccccaaatgccttaaaagtttttctattttccccccaaaagcattataattttatgttttacatttatgtttgtgaacaattttgagttaatttttagataaggtatgaggttcaggttgatgatcattttcgtttgtctactaatatccaactgcttcagtataatttgtttaaaaggctatcctttatttaattgcttttacacctttgtcaaaaattaattgggtacattcatgcaggtctatttctgggttttctgttctttcccattggtcagaataaattactatagctatacaggaaaccttaatattggtagaataataaaatgaaatgaaacaatttattcttctttgttcaagattgttttagctattatagggcttgtgcctttccatataaattttaggataaacttgccttactgtatacacacacatgcaccccttatgagtacaggcatatcttgttttattgtactttgatttattgtgctttacagatattgtgttttctacagattgaaggtttgtgacaaccttgtgtcaagtaagtctcttagcgacattttttccaacagtttatgctcatttaattagcatttttaacaataaagcatccttaaaaattaatgcataatatgtgtacacattttgggggtacatgtgatattttgatacatgaatataatatttggaatattcatctctttaaacatatatcttttctttatattgaaaacattccagttcttttcttctagctattttgaatggtacaatacattattccgaactatagtcactgtcctgtactattgaacaccgaatcttatttcttctatctaactgtatttctgtacctattaaccatcctctcttcatcctctctcttcgctacccttcccagccgaaagtattttttcactaaggtgagtacattgtttttaagatataatgctattaagcacttaataggttgtagtgtaaacataacttttatacgcactaggaagctaaaaaatttatctgacttgattcattgtgatactcactttatcacagtggtctaggcctgaatctgtaatatctccaacatatgcctgtatttgataagaattacattaagccaacagatcaatttggggacaattgatgtttttactatgtagtgttttctaatccatggacataagtatgtttccctgcttatttaggtcttacttgatttccttcatcaccattttctaacttcagcatgtcttaagtttatacctgaatatttaattgctttggagttttttatttcagtttacacatgttcattgtcaactttattgagaaataagactgatttttgtgtgttgatcccttatcttgtgatcttgctgaactcatttgttaattgtagatttttttttgtaaattctttgagactttctagattaaaaaaaagtcatctgtaaatagagacatttttatttcttctttctccaatctgtattcctttatttctttctcttgctttattgcaatggctagaacttccagcactgtgttgagtaagaatgatgagagtggacatacttgccttgttcctgatctgagggaaaaaagcatttaatattttactgttgagtatgatgtgatctgtagaattttctgtggattctttttatcaagtagaggtcattctgttcaattcctagcttgccgagagattttcttttacatgggtattaaatgttatcaaatgtcttttctatgtcagttgatatgaccatctaccttttctcctttagactgttgccgatattgtaaattatatcgattgcttttggaatgctgaaccaatcctgtgtatctagaatacatttcacttgattatagtgtataactgtttttatagattgttagatttggtttactaatattttgttgacgacgttggcatcttcatgagagatattagttttccctttgtactgaccttgtctgattttgatatcaagataatattggcctcaaaatgcattggagactattccctcctctttcattttctggaagagattatgtaaaagtggtgtcaattcttctttaaatttttgataaatttccctagtgacaccatcagggcctggggattttttttagaacattttaattacaatgtcaattactttaatggttatctactcttgcagattatgtatctattcttggttaagttttggcagttggagaaattggtctgtttcttcttggttgttaaagttatgaacataaagttgttcttagtattcccttattaagttttgagagctttctttaaccatcctttaagggtgagactgttggtaacagattctttcaaagttttttcatctaagaatgtcttttttccccctcttattcctgaaggtagtttcactggatatcagattcacagttgatagttcttttcttcaacataaaaaagtgttgtgacactttcctctgacctccatggtttcacatgcgaaacctgctattatttgagttggtgttctcttatatgtaatgcataatttctttctgattgcttttaagatttgttctttgaacttatttttcagaagtttaaccatcatgtgccttgccttgaatttctttgggcttatcataattgcggttagctcagcttcttgaatgtttatggctttcatccagtttgagaagtttttagctcttatttctctaaatactttttcagctccatattctctctcctttccttctacaaccctgatcatataaatgttagatcttttgttactgctccataggtctctgagtatctgttcattttttctctattttctcctttttgttcaaattgagtaagttctatttatttcttcaagtttactgattctatctctgtcatatccacttaatacttatgactctagatattcagagtgaggtgtggcgcactttggtagtgaaggagctgaagaattgaagtggccaaattcactgtcttttcaattccagagaaaatatcaatggaggaagagattctcctacctccctggatacataacacctttaggatgtcaacagacattttaaaagctgttggtgtcagagagacttatccaggaagtgataaaggtggcttgtgagatctggaagctgaatattgttaatgaaggataaagttctatacggaaacatacttccaaacacattactcatctatttatgttctctttgcttgataatttggagcttcagtcatgtttttagggtgaatactatttacacattatttcccattgctgccatggttctattttcagggcaaagaaattccataattgggattatagaagaagaaccagcagccactgggaaaaccagaatgttcctcagatcaataaatgagctaatatttgaatgagtgagttatatggtttggcactcggtcccaaggcaaatctcatcttgaattgtaatccccatatgtcagaggagaggcctggtgggaggtggctgtatcatggcaggagatttcccccttgctgttctcttgatagtgagtgagttcttatgagatctaacagtttaaaagtgtagcactttccccttcgtgctctctcacctgccaccatgtaagacttgccttgcttctccttcactttctgccataattgtaagtttcctgaggcctcctctccagccatgcagaactgtgagtcaattaaaactcttttctttgtaaattacccagtctcaggtatgtctttatagtagtatgagaatggactagtatagtgggctaagagtggcatagaacacatggatgttttgggcatgtttctgaagatatttgatagagggaatggaaggtggatttgatcaatcacttggggcttggcagatcatatatgtatttattttaaatatactgtacatgaagcttctctgaccagaaagacatatgccgtcattgaaggtattatgtgagaacatgagctcttaagttgaaatggaaaatacaacatttgagcttgcttactttcaacaatcgagaaaagaatagagactaatattgatatttcaaacgttacggaagtgtgtgaaattaaaaaaataaacttctactcacagttcccatgttgctaatctactgtcatataaccctctgtggatcttttttcagcctattaattttatgtgatcccagtatggattagcatttcagttcatgatggttcaagacttatctgatctacaattcccaaagctaccttcactacttatccagatagaaagaaatacattattatgctttataggtgtattagtctgttcacatgctgctgataaatgcatacctgagactggatatttatacagaaaaagaggtttaatggactcacaggtccatgtggctggggagggcttgcaatcatggcagaacgcaaaagtcacatcttacatgacagcaggcaagagagaatgagacaaccaagcaaagggggtttccccttataaaaccatataaaaccatcagctctcctgagacttatttactacctggagaacagcatgggggaaatcaccctgccatgattcaattatcttccacttggtccctcccacaacacgtgggaattatgggagctaaaattcagtaggagatttgggtggggacacagagccaaaccatatcaatacacaagtatatagcggggaaaaaacagaactcctatagacatagacacaaagaaatgcatagctctgtgtcacaaacaaataatacctgaaaatggaaacagaacactcacaaagatattgtgatatcagattattatctgaatattctaatctttaggtcagagctctttatcccagcaatcctagtattgagaatttatcctaagaaaacaatctttttttttttttttttttttttgagatggagtctcgctctctttgttgctcaggctggagtgcagtggcttggtctcggctcattgaaagctccgcctcctgggttcacaccattcccctgcctcagcctcccgagtagctgggactataggcacccgccaccacgcccagctaattttttttttttttttgtatttttttagtagagacggggtttcaccgtgttatccaggatggtctccatctcctgaccttgtgatccacctgccttggcctcccaaagtgctggcattacaggtgtgagccactgtgccaggccagaaaacaatcttaaagtagaaaacacaacttcatgcctcaagaaatttattgcagattattaataacagcagagggtaagctgtatcatacatgtacagaagttgaatgcttatgtcgagtgcattgtattcatttaatgatgtactagcaaatgatcttaagagcatgccttactccatttatgcttctataacagaatactacagactgaggaatgtataaagaacagaaatttattttaccacagttctggaggctgggaagtccatgatcaaggcactagcagatttggttgtctggtgagggttgctctctgcttccaagatggcaccttattgctgcatccttcagaggggagaaacattgtgtcctcacatggcaaaatgcagaagggcaagcaggataaaatccctcagtcgagccctctcatgagggcatctaatcccattcactagggaggagccctcatggccaattacctcttacaggtcccacctgttaacagaagcacattaggcacacctgagttttggaagagacacattcaaaccacagcagagcacaaaatcagatagacctgggctcaaattctgactcctgtacgtacctgggtaagttataaatttgttaagcatatttccttttgtattatataaaatagaactaattattccttcttcacaaagttattgtaaataactaatgaaatatacatataaagcagatagtacaatgtctggaagagaggacacatttggaataggtgtttgaaaaatacagcttttgtcctgctgcttcttttataaataaagctttattgaaacacaaccgtacccatttgataccaattgtctatggttgcttttatgctacaataacagagttgggtgtttgttacagagagagcatgatctgcaaagcctaaaacatctatcaaatagctccttaagaaagtttgccaacttctgatttagttcatagtaatgatttcacaactataaaaggtgttttgtaaacaatagcaaaataaaaaataaaaactaggttatatgcttaatggaaaaaaataacctaaatctatactcatatttgatagttaaaactatgttgactttataactgcttatacagcacttaaaaggaagagaaataaaaccgattcattagatttaaggaattttaagagatattcctcttacaaatttattgtttttaaaaaagtagaagtgcaataacaattatcattgaaaaatcatgtcacctcttaaagagttcaggaattcaagtcctctctgggtgtggtcatgagtgtctctagggaaatataggcaacttcaattagaaattctctggcctatgtggttgttctcaaggttcaggtgtctactgatcagagggtaaaatgaagttccttctttactccctttccagctccttcagccagagccaaagtatttctggctatagggcttaggcttattagaaatgcaaaataagtatctaatagtaggctttttaatagaactgttcttagctgtcaaaagcaaatttatattaccacattgattagttgctgaagacttgcaaagcttctatttctgatgggattgggactgactatagttaatgttttttttttcctgttgtgttgcatattccttgtttcctgctctgtgtgtatgtgtgtgtgtgcatatacatgtatatgtatatatgtaatagttcacacatatataatacacattgtatatatggtatatatacacttttaaagggattttaaaggcatttttatggttaggctaattctctttcctcttgaatttttttcatagcatgttttatataaaggtaaaacatctaattgacttaatagcaagtttatcttttttttttttttttttttttttttgagacagagtctcactctctgtcccaggctggagtgcagtggtgcgatcttggatcttcactcactgcaacctccatctcctgggttcaagtgattctcccacctcagcctcccgagtagctgggactacaggtgcaggccaccatgtccagctaatttttgaatttttgtatttttagtagagacagggtttcatcatgttggccaggctggtcttgagctcctgatctcaagtgatccacctgcctcagcctcccaaagtgctgggattataggcgtgagccaccgtgccaagtttctttcttaaacccattttctttttgttatcattatcatggctcagttttaggtgtaacttttgatcttttctgcctagactatcccttttacatttatcagagtattctttatttaaaaagtccattatttctttaaatatattttatgcttctttttctctctcctgtccctcttgaaatccggttacacatgtgttggacaatttcatattgtcctgtaggtcactgaaactctgatacattttttgtttaaaaaagtaatttcaactttcattttagatccaaggggtacatgtgtaggtttgttacatgggtatattgcataatgctgaggtttggggtacaaatgatgtcatcacttaggtactgagcatacccagtaatttttcaagcctcacccctcactgttccccactcctatagtccctagtgtctattgttgctaccttgatacatttttcaatcttttttctcctctttaaattggataatttctaagaatttgtcttcaagtttactgagccttttttctgtaatctccagtttgctgatgagcccatcaagttatttttttcatttcagatgaattttctgcttttggatctctatttcattctgtttcatagttttcatttttctttctctgatgttccccatttgtttcctcggtttcctttaaattattgaatatatttatggatcttttcctgctaatgttagcatcttaaatgaggtctttttgtatttattattgtctagtattgtccagctttcctgcttcttcacatgtctggtaattttttattatatgctgaatattgtggattactcaatagaagttggatcgtgttgtcttcctttaaagagggttgacttttgttctggcaggaagttaatggactggtggttctccttgatcttactgagtcttggttttcagctttattaagtgggtccagaatagcccttactctagggtaagagttggcaagcttcggtaaaggaccagatagtaaatattttaggctctgtgggctacatatggtatctgccacatattcttactcattttattttatgatcctttaaaaatgtaaactccattcttagcttgtgggccatgcaaaaggaggccatgggcttgtagtctttctggtgtgtcagttaaatatctagggtattaatgagggctctgtactctggctggactgaaataccatctgtaagcactgggtgaactctagtatttctgttccactctcaacccattggcagctactttctgctaggtcccatggagccttgctctgtactttttcacctgaactcctagccaaggacctgcaggacactcccactcagacttctggagttccttcactctattaccatgctgcacacagtctaactggttcagttaatttcagtagctgcctctttctgaatttcggtggctgcctctcccattcagtaggaccatcctgctctgctaaagcttgctacctatgtgtgccatggttaggaaatttttcaaagacaaggatcagagatggatttagacttctcttcctatgtttcccctgcctataggccaatgtctggaaacaactgcctcagctatgcctccgtttcatgcttacttatcacaagaggtcaagtctggtactgattactgtgttagggctggagagggaaatcccacggtggtattttagaaaaccatttgacaatatcattctcatgcttcaagtccttgaatgactccttttcacaccaaggataaaaatacaaactcctaaactttgtgcccaagattcttcacaatcttttgcctatttacttcctttgccccatcttctgccatgaaccctgtgcttcaggcatactgagctttgaaccaatgccccaacatatcttttatgcttctgtgagtgtgttctacctgttaagtcttaatatcatttattcattctgggcctgatcaaattcttctcattcttcactttcatgtcactgcttttgggttgatttcctgaactcctctaggtaaggttagatggtaaatctatgtattcccatatcaatttgtacatcctttaaaatacttatcattttgttttaattacttgctatacgtctttcaggttccaaattcatattctttctggtgagaagggacattgaatggtgttgtccaggggtaagacacggaatatggtggagactgctcacctggaccatggataccttgtctagagggtactatggttattagcatgaacttattcttgatgtatgataatacaaacccagtgttgccaaactgcctaatttttcaagagaagctggaattcaggatttatacatgtaatttcctgatttttaagtgtacacacacacacacacacacacacacacacggtaaaggccaaacaaaatttctgtgggctgaatatatccctcgagctgaaagttttttgcctctgcactagaaaatggtttggagtaaaatttccattgttacaacaatgcaggcagatgatatttttggatcagatgcagtattttttgccaccaaatatgttaaatatccaacaagccatggctgagacattacaccaagtccatgctgataagaacttttcatttgtttgcttcatatgtgatctgtagattcatggcactaactactatttgtagatcacataactttggaatttgtaggggcctgagcagttattctcagagtctatgctggaactgccttttctctataacatcttggatagatcgcagtccatccgtaaatagtgcacacctaatatagcagaactcttaccttgtaaggtaatttagttaattatcaagcacttcacttatctaagaggttttcattatattaaacaaatccagtttccccgttaagtagtcttattgaccttttggaattctatagcaatatctaattcctcttctgttggatggtgctaattatctcaataaagctaccaaaaaaaaaaccaaaaaacttctgatcctaagtcttatgaactccctgtaaaacagcaatgattccttctcttattttcctttgtcatggtttccttcatctaccccaaactgattctggatgttagcaacagctcatgtgaaatgtgaatagaatgctctagggctttctggtcaacacaagatactcgtctcaaagacatagatggccacatagctgtagacgctgtaaatgcagcaaggttgaatttactgttcagcttcctcatcatgtggttgtcctacagtgagcttactatcaacttaggttcctcggctactttagtcatatttttctttagccatgttttcccatcctgaaacttcatagctggctttatggacttaggtgcagtaatgttcatttctatcatattattttattgtattagagatgatccattctccatttttagtgagttggaagaatagatcatctctactacaataaaattgagacgaatgattcatctcaattttaatttatttgttcattcattcattcattcattcattcaactatgtatcaagcacccatttatgtgccaagtactaaaagtacaatgatgaagatactcggagattaatgctaattattcaccttgtttactgctgcttcaaattttgtatcacctgtgaatgggatgagcacattaaggtgacaaaaatggccaactaagattatatgccagatatagaaagatgtttgagaatgtctcgatgtaatttactacattaacactttaaaaaggagaaaaaaattttataataaaaataaatgtagaaatggaatttgataaaatgattcatcttttctttgtgttaagataaaaaccctgtagattaatatggaaaataatttcttaacttgataaagaatatcttctgaaaagtgacagcaagcattataattaattgaatagacatagaagcattttttaaggttaagaataaggtatagatgcctatcattgtcacttttgtctaaaactatattggaagcttcaaccaacacaataacagtatgtaaagtaatcacaggtatgaggattgaaaagaaaaagacaaaaggtcattatttttaagcaatatgattgttcatatagaaagataatctacttataatcattacaactaataagagagattagtaatattgctgtatacaaaatcagagtattaaaaaagtttatatacatcatgaacaattagaaaatgtagtataaaaatacatattatctgtaatattagcaaaactatacatggcttaggaatacaatgtgcaatactttagggaaaaattataatgctttactaaaggtcatagaagaaaattcaagagagagacatgtgttcatggagagtaagatcaatagtgtaaagatgtcaattttaaagaacttgaaccctgtgggaaaagcactgcaggagaagtgtaagtattgggtgatggttgaggtcagccaagcacagcatcatggtatcaggaaatcagcaactgagacttcacatgctaagactgcatgacaaaatgagaagatagatggcccatgtttggtggtgaagggggtgaagttagtgtttataatacaattctatttccagtagaaaaattaaataactaaaaatagtctccgttatgtagactgtgtatatatgatgaaatgagaaaggctactactctgtggcccttctgtgtatagtccgtgtcctttttgaaatggatagaatactcagatgggggtagtaagggagagtttaaagaactatttataggactatcaacaggggtgggggatacctaaaatgatggtaaagcagctaggggctggcaataggtcggagtcactgtgatccctaggctgaagacgcacagggttaatggctgttaatggaaatcagagacatagttgtagctgtaggaggatcaagagatggcaattgttactttctgtagaggaacacagccactgctaaacaatggcccagcagagaggacttggtggaataaatatcacaacctcgctcctctcctaccctccatttatctgttggtgacctccattgaccaactcctactgaaagtcagagagaaaaaaaatcccattggtgtagtccataaaggtcgacatcccagagcacagagcagggcaaagaagagcaaataatggatttagaggggaaaagagagaatgttcagcgcacaagagtagctcttcaccaagcttatatgttacaagtctactcacactccattaactgatgagaatcaatgttgaggagtggatgatttttacactttccaatcaggactagaccagagcagagccttctaaagaagggtcttcagtgcctatttctaaactatgctggggaaagcaggatctgactggagaataagtcccttggtaaacaaatgtgagtatttgccttgttcagtccagcttatgctctgaacaactaaggatcttgtactatataccaatgtacccaggtaactccaattattaggagccagtgaattggatatatactttgtgctcattccattctccttcctactgctgagtcaatcaccggtgaaatggaactcactgcttggattgtcttcatttggatctcagttccgtcattaaacaaatatttattgagtgccttccatgtgcaagacactattcgggcacagtgggaatatcacaatgagtaagagagtccttgccctccagagcttccaggttggtaagaaaaagaaactaaattcatagaaacctacaatgaaaggctgaatttgttatcctactacccctgtttttttccccaaactgcttctctttatgggcagtgtggttgtcctccatcttgtttgtgttgatgtctcgattcttttttttttttttttttttttttttgagatggaatctcactctgtcacccaggctggagtggagtagtgagatcttggggcactgcaacctccacctcccaagtttaagcaattctcctgcctcagcctcctgagtagctgggattacagccacatgccaccatgcccggctactttttgtatttttagtagagacggggtttcaccatgttggccacaggctggtctcaaactcctgacctcaggtgatctgcccgccttggcctcccaaggtgctgggattacaggtgtgagccaccaccccaggccagatgtcttgattctttttgtcaaacctgtccttagaaatactatgattgtaggacttaggaggctgtaagcaaaatgtttaaataatagcatgttggtgtttactaggagacctcttccctaaacacatcatgcttttgctgggggtaggatgggactcagaatgtgggcttacttctttgtgtctctatattgagtagcttcatgccataagtgttattagcacaactagagaactatgcatatttataaagtgtgatcagtgttattctctacacattagcttgagggcacatggcatttaactcttgcaattccagactcatgcagtgacctgagtcagagtctgcaattttgtcttcagccctaccttgatagcaacagaatccacccaatcagaaaggaaatgaaaaggggaagagtgggtttttggtggggaggggtgcctttgcagtgagctctgctctgtctcaatctttcttacaggaggctaagcattagtagccccaagtcctatggatattgtgtgtagattctcttgtcttagaacccaatggctgcagcaaggtactcatagctacttctgttttccctagaattctctagccagttgtccaccaacccaaagactcaagtagaaaaagtcccaagtatttaagggctcatcccaacctaagaggtccacatgagcttcagaatatagcagattgggtctcacattcattgttttgttgttgtttttcggttttacataaacgtgagtgccagtatctttgggttgagactgggcctctaacaaggcccctgaattccagtctgctcttacatctgccctcttggtatagttcaagatccactcaaagtggtcctcagaacagccttcaacagattttggaagaaaataaaaggaggcccatggacagaaaacttagggagatggtgcataccctcttctcttctgaggaacaaaaatggtaatcatatattagaggctctgagaagtcttacaatcaccataaggaaagaaaaacccactttgattaaacccacattttacaaatgtatttgctcatacatttctcctctcctttagggaaaatcacaatatgttggattgtcaaactttcaataaatgtgagtggctgttggcaattggaggtctgcggagaactctaaagtttccaggaattggaactctaaaggctaccttccgggactctgccggctacagtcagtccccacatctttgagcttctgtggatacctgaccagcggtagcttcccagtgaatgccctttatgagccagcactgggcagggtattgcagtcagaaggcgtgagacaagcttgaggcagtgccttaaagggtggtttccatggatgccacccagacccagatcccagaggcacacacacaagcacttgcatctgttttttcactcggctggcttgcttcctcaggcccagagctagggtctggggattcccatctgggttctgccgttaatgggttgtgtgaccttggagcagttacttaacctcggggtcctgtttcctcagctgtaaaatgagggggttgcattgtgtggtcccaaagggaggcttccagttccgctactctgtgaattttgcaagcacaaaattgtgtgtcccctctccatgcctcaatgcttttgtcttgcaaacgaaatgagtgtgagcctcagaaaaagtggggtggcttatagaattgatgaatgcatggtggtttaagctggagttccagttcttgcctgcacttgcaccttgcatcctgaggctgacatctgcttattgtcaaacaactggaagacgcacacataagcaaaatcaaagatccaaaatgggaagctggccacagggaagctgggcccttaagcagtggttacaaaatgaagtatcaagaggtcgccaggaaaagtgaaagagaatggtctggtttgaatcctagcactagctgcttaacctcacttgatccgtttcttaatccttaactcctagctctctgggtcatcctaagggttcaatggggagcaaagctttggaatcagacaacttaggttgatggctttgctctgcaactcacttactgtgacctccagtgggggttgagtaactcttatctgaaatgcttgggaccagaagggtttcacatttcatatttttgtcaggttttagaatatctgcatgatattaatacttatgctccaatgagcatttcctttgagtatcatgttggagtttggagcattttggatttcagattattggatttgggatgctcaacttgtagtttgtttgctattgttggttgcagtcagttctcagtaaatattggctctctccatccatatttattatgttctgtccttttccagattcatatgatatgagacatcattgtccaatttcttccttacaacagtattattctttttttgctagatgcaaagggaagccttgacataaacaaacaaaacacaacctgattttttgagccatttgaaagtttcttttataaacaaactcatttcttgaatcatcttttgtcccatttaattagtatttatttgcctctgtgttttagtctcagtaggcaaaccaggaagtgggagctgaggtcaaggaactttcttcttgtggttctaagctcatggcacacagggctgagcctcctgggaagcagatggagaaactccagatcctggaaaggagagagggggatgcctgcatactcttctgccccagtgagcaggtgtgccccgcccctgtctctcagcaaagacctgccaagtaacaattgacacattgtgtggaaataaaagcagtgggcgagtagctgcagtttctaatggcagcgtgggtagtcgggggcgggccagccccagcagtgacagctgtggtacccaacattgtcagtgcagacgctgatggcctctgttccccatgcctgcccacatttgtgcaccctgtcactgcagggtgacaagcccaaacacagggagcctccctttcttatgctaatgctctgtaatgacagcttccccagcccaccaggtgtgacagccaccagaggcagcctccactcccactgctgagtttcccaccccgagtcctggacctgattcaggatggagcctggagaaggacagacaccctctgccagccatgaagatcccaggcccacaagttgctggccctctgtagcctagatcttgactctctcctgctcattagggcatcttgtcactgtccactgtcttcatcttcatccaccctactccttgctgtctaaccacaagcgtcttctttatgttcttacatgcactaaaaccttccttgttttctcttgctgttctttcttgcttggagacctttgacacttgctcttcccttccttgatttattcctgtccttcaggactctgctaatgctgccgcttctctggctttcttgttctatatcgatagccctgtgtttgttcttcaacatcactgtttatttcctagatactattgatattgatctcagtctttaatgttcttgtctgataatgtatttatttgcttatttgtctcttctactataatataaactcaataaaggcagggacctggtctgtcttgttcacagctccatccctagagtctattccccattgcctggaacatagtagctactcaatgaacacaagtggaatgaataaatgaataaaaatatgcatacaggaaaacgctcccataagtaactgtggctcatcaagcaatgatccccaaatggggagtcatgaccccaagggcacacactgtcttagaaaagctgcccagtgatcctagtgcttgctcttttgtaagagtaagtgaactctgctgcaaaggcctgttcctgtgcagccttctgcttcttttgctttcctaaattttatttgtctgatcctttagccatgttctatgccaactctggttacagctagttaaatgattaacatttgctctcccaagctagtccagcctgagggctatgggtaaaaatcatttaaaaatcttgttttctttctgaaaacttgtaaggatctctctttacctttgaagtttggaaatttcacaagatacctagggtgtatgtcttttttcattagttctgcctggggctcagtgaaccctttcaatctgaagaccaaaccagcctgtcctctaattcacagttttcttctattatttgattacttttctcccattcattttcctgtcttcttctgggtctcctagtaattacttaaatctcctgaattcatcctttaagtcccttattggctcacccttgaatctccttttaaaactttaattcttatgcatttatgcatttatgtttggactgatttgtaagatgtttcttctaattggtctttccatcactaactctcaggagtgactcttcactttttcaaattttctattaaatttttaaattttggaaacaattttcttccagaaagcctgtttcttgcctcagtcacatctctttgagagggaatgttacttttctatcaaagttgttttttgttgtttttgttttttgttttgttttttctgtttatcacaattttttggcctcaacaggagccatctgtccctatttgtcagcctggtcccctgtctcaagttactgagtctctttaaaatggatggaggtttctttgccttctcatgggtgtggatgcctccgcatccataaatgtggtaaggacactgaggctcttgttctggtgggtttgtgctctgtccttcttaaccccaattctggcctctctccctagtccactgtctcctccacagaatctcacatcctagatatgctcaggcttgtctctggatttcatactttggccagttcaattgttttgagtcacctaaataggaaatgtagaaagactgagcagccacctttccagaatgtccagtagcaatacaaaatgcagtgggtaggtggtttggttcttagcctaccccactgtgatcaccggggaccctcttccctatctatggcccctctgttttcctgaggatatggtggttacctcaggtgctccccttggtggtcaatgaatttctctagcttcagcttcattctcccatcctcatccctgcttcccctccccaaccccgcgtcgtcctgtcactgaagacactacctatgtctgctaatcagccatcatgcacatgttaaacctgccttgactgtcctggctcttcttgccacactgatgtatggattcctttgtatcctgcctcaaaacaaatcttcatttgttatgctctggcaatctggaacattgctcagagctggcagcctctgggtgctcgattcaaaagtagctcttcctgcaggcaatgaccagaggatccccagaactattttgatcaagttgatcaagttttatccttttctaggctgcttatttattctatcagttctcaaagtgtggtccagaccctttcaggagtctgtgcagtcaaaactaatttcttgaggagattagggtgttaattttcccgttctttctttcacaaacacgtagtggagtttccaaaagttatcccacatatcatgacatcattgttctggtggtgagtgggatgtgtaaatgaatattcttgggtttaaagcatttatcagttctaatttttaatatggtacatatcaatagctataattcacgtaaacgcaagctccttggagtattcaacactttttaaaagatgtttacatcttttaaacagtcctgaaactaaaaagctgaacaaatattgatgtattcatttactcaaaaaatattattgagtccctgctgtataccagacactatttttttgtggattatgaagaaacacaaagaatgagacagagcctttgcttttatggacattctagctggggaggtagacaactacaagttagtaattaaggatagtatctaatttcaggtggtgataagtaaatgaagaaaaaacaaagctgaggaaagagtgcaaatgccaagggttgcaattttagatgggggagtcagggaggcctctttgcagaaaccacactggatcagagacctgaatgatgcctaattctttgtatcatttctcccaggaggataagaggcccaaagtgcacatggactcatggttgcccattaggacatgaccgggctttctagtgggtgtgcaaaatttgtctctcatgaaagacattactactttaaatagatcaatccaaagttcagttcaaaatgtttatcacaatcatatgaatcatttatgaaatatttaatagctgatagttaccacgtgccagggattgtgaaaattatatcacatgcatttctcattgaatcctcataataacacactaagctaaggactattcatatctctactttgaagatggggaatcagaaggctaaagatgaagatgcaaaatccatcatcaaagcagttagcagcaaaaccaggtttcaaatccttgtttttctggttccaaaatttatgctcttgaccatgaggcaattgtgagaggcctgggaatctataaataaattcacattcctttctttgtagaagctcattgtattatggaaataataaatagacagtaaattattataccatgtggtaaattctgggatttagaaaggcatagactataacaagaaaccaaaagagggtcatttaacccaactggtgggaaagcacctatagaagcttctagaaagaggtgattcgaaatctgaatcctgagagttgtgaggacaatcaagggaaaaaagaagagaagtatgttcctggttaataaatgagcataaacaaagacactgatgtatgaatactatacagtatccagaaaactgggaagttcagtattgctggaacatgagaaatgggagaaccttcagcaagaggtcatggagttagaaggtttgtgattatagacagcattatgcaacatattaagaagcttggaatttgttttagaaaaaaataagaaatcattggaagtttttagacagtcaaatatcaaggtaaggattattttaagtaaaatgctctgataaccactctgaggatagatgtgaagaggaaagagcagtccagttaggagagaaatgtagtggtccagggatgagataatggtggtttcctctgaggtaaagaagatgaggatggaggagaggagggaggttgaggggtcatgtggaaaagtcagcagggtgaggtgactgattgaagttgagattcagtgaaagggaaaatgagggtgattcccagattttggctcaaatgactagattgactagataaatattggttccattggctgatttcaagaacaaaggaggagcagcatgagaggggaggttggcagaatgtgacatgatggtgcacgtgcagtgcatttgaggcaccagttgcttgttttaggaatctgcagctcaccacagagatctggagattgggatctggacattctcaggaactcagtgaatgttaaaatagtaggaatggatgagatcatccaggagcaggtggtagaacagtggtgaggaaacaaaacagaatagcaacagcataatctttaagaatatttaggctctgtaaccaaagttttaccaaaccagttacagaaactctagctaacaaggtctttttatctggtggggctaggaagaaaatggtgtaggaaagattgctatgaatgaaagaaaggaagcaagtgggcaaatactacagtgaaagcccatggaagagggagaagagccataggccagggaagatctatggagaagagacgaccaggaagtggataggtcagggaggggttaggttgttggtccttccaaaatttatgctctttatatgtttaacacagactaccttctccattcaaatcatgtcagaccaagtatccaataaagacaagattgaggtccatactacactgggcttccctcttgctcttatctgaaggtcaatcttaccaatccctctgtgccataatccagtaacctaggccatcaggttatagatctcctggaaaatctaaatcaaatgacaaggagaaaagttagctttccaactcacatggtcctgttgctttctggttccctgggaagctacatggacaaagatgtctgtagggctgaatttagttgtcttttcttcttacattgaaaatttcatttaggcttctgaaagctgtggaattcatagtcttctatggagacggcctcttttttggtggtgtaattggagtcaagtacttatttgttgcttgcaaacttttagtagcgaaaataacattaatatgacgggtaagacaggagttttactgagagatcaatgacaagaactggctccagaaagacaaataatcttcatttcacatggcaacctaatgataggtgaggacagatggtgacaaccctcaacctggaattcttcttgaatcaatcaatcaatcaatcaatcaatcagcaactatttattgatctgctgttttggctaaaaacacagaccttggaagcagaagcctgaattcaaaacccaagttttccatgtacccgtggcttatttttgggagagctcccgaacccgtctgagcctcaatttctttctctgaatagtaaggaaaataattgtagttaacccaatgggttcttgtggggaccagttgaaatgtaaggacccagtaactgtcagctgctattattgttgtttttgatattattgttgtggtagttgttgccgtgattgttacaacttctgagtgctctgggctactgtataggctttcttttttccaggcggattttatgatgttccctggaaatgtgccatgggggcttcaaagaaatttccaaggtggccctgggcttcctggatacttagcgtttatagttttccgaccactcagagaaacacatgggtctcagcccgtgaggatcccatggggagaaaagggaaggaaaggaccatgggggtaagagggaggtgaagagaggacacaggccgtcaggagagagagagaaagagatggggcatggggagggaaaaactttgtggtgataaaagaagaaacccccacgcttgtaatcccagcactttgggaggctgagggggcggatcacgaggtcaggagttcaagaccatcctggctaacacggtgaaaacccatctctgcaaaaaattagctgggcgtggtggcacacacctgtagttccacctactcaggaggctgaggcaggagaataccttgaatctgggaggtggaagttgcggtgagccaagatcacaccactgcactccagcctgggtgacagagcaagtctccgtctcaaaaaaaaaaaaagaaaccacaagtttttgccatcattccttcaataaattaatatctctagagtgcctattctgttccagatactcttctaggtgctgaggataccacagtgagtaagagatatgaagtccatatcttcacgaatattacattctgtgtgggatggaagggagcagacattaatacatcaaataatttcagataacaggaaatactttaaagaagattaaactgcgtgagttgctagagattagcttagggaggatgagaggacctacttcaagtcatgtgttcaggaaggacctttttaattactaaagagagattcgccttgtttgggggcaccaggttttacccagtactgaagtctcattccatgtggtggatctaactggcctgttctcttccctttcactaccttttcacaagctcctctcctcctcatgggcgacagacagcctttcttattaatgaatttgggaacaggacctaggtattcatagctcagcctatttcctctcctttttagggcagagtgaagtgtttgcaaataacatgtagtcttctatgcttcttcatgctttaggtttaccagggcagaactgcttgttgggggcagctgcagtggtttggcacattcttttctggggttcaggattatataccagcctttatgatctaaggcagtggttcttaaaatgtggtccatgaatcagcagcatcaacatcatctgggcacccattagaaatacaaatatcaggccccatcccagactttctgaatcaggtgttctgggggtggggtccagcaattcttgttttaaccattgcttcagttggttcttacgtgcactcaagtttgaaaccactgcttaagtgcagttttactttctctaaaatgcggtgttccaggtgttgaaaagctttgccattccaatctgcttgaagtcagtggcaaagagcctaaaacttgaatgtcaaaagcttttgcagttcttttgtgtatctcagggtacctcgtcagcctcagcactaatgacatttggggttggttaattcttgttttagggggccgcgggggtgttgatcttggacgttgtagggtgtttagcagcatccctggcctttactcattagatgctagtaacgttccttcctaactccagctgtgacaatcaaaatgtctccatgcattactaaatattcccttgaacacaagatcatccctggttgaggaccattgatctatctgcattagttgagagtatagcttgtggtttgttctccaaaaccactaagtcaaatgtcctgcttaaagaaataataatacccacatcatagattgttgagatgattaaatgtaaacatctaaaaaactgttagaacagtatgtgtcttataaaaatggtcacataaattaggtattagtaattcttattgtaattaaataatatatagactatcaaagatctatttaagattagttgttagtatcattattacttgaattattattatttctccttatctcctgaaatgcctatgcagaagttaattgttgttgttaattttacttctttatctcatgaaagacctgaaattgcctttattttgaatatggcacttctagatcttttatctattaagagaaaggatcacaaagacctttgttcttattggttttgccttttacccacttatgcctttcagttagaaaaatgtagcaaacatgtgactaaaccactcatctgtttcccccactctccttgaggaatgctcaaacacatttggatagtctgttttctcagccctcggagtcttgtcacttactccgcccacttttaaaaagaaaagcaggttcattccttacccccacccctatcccatgaacactgtgatcctcatatgtatgtagagactcttttaaaataaatttttcatagtgtgccaggattgacagctgctgcccacgtccttaatgctgtaacagcaaacatctgaacaaagaggggaaaagtcagtaaaccatctggatgtttcgttgatgttttgccatgcaatagaagttatgcaacatctggatgacaacctagtactttgcctttctattgggctgcttgggtattgagtagacacagattttattgtaacatggtcataatgtacaagttcagaatttcaaattcaacccaaatcttttggagcctgaattcattcacccttggcaaaacgtgagtatgtatttttaaagcaataagacttggaaagtttattaaaatgtctcaaaaggcatttggacgtcaaataactctcaaacccaatgtttttgcgattcaaatgaatcagaaacatatggattaaatttcctttaaattgctctcaagattaaaaatcaagggaaaaagtgcccagggccaaatatgttttgggttttgcaggacaaagtatggttgaaactgagctgaagatatgaatagcacccatactgtctttttgaaggaccagagttttattcacagagcatttattctcactctgccgagcaaccacacagaccaccaaacacaaccataataacaaacatcaacagttaaaatgtctgctaatttgcagttagccaaaaacaaaaaacatacttcaaagtcaaactaaagacgtctctttctaaagttcccctgcaggatctgaaaatgattaaaaaagaaattatgtctgaaaaaggagctgtttcaagcattatttaaaagtgggcagagatgggccttctaacagccaagacacctcaagcagcaaccagctctggactagtcattcttggactcagataccaatttaaattcagcgccaaggggtctaaactaagccagaggaaaccaatctggaagacatgatatggatgagcatggaagcttagttctccataggagggttctttatttgatttctgctattcctactattctctactcttgccaatgaaagaacagaatcagaccttattggtgaccaaaatacgtcttaaaacataaaacacatgttttaatctgattgtctcatatcaacttttttggtcaaattatttgaccttccgtttctgcttcttcagattaaaataatagatctcttttcctaagtttaccattcttgactttgaccagcccctgaaggcaaagaaatatttggaagaaagagtaagagcacagtctgaccttgcttgctttatctagttggctctcctgcagaaattttccacaccacctcccctgtacctcctgttccccccttcccggtattaatttcatggcttacatttaggaattttattatagttaggggttgtatttattatccccttttatcaagtttcacatcagatctctgaaactgttatacatttcagaaagccatttatttgttcaacaaatatttattaagctcatactatgtgccaggtacatatttactgaagatatatctgtaaacaggataattcagagtagatgagtacataaatggataaataagataattggagatagtgaaaagggttatggagaatataaagcatgttgatgtgatgagaatatcagtgagtgcctgcatatcaggagggagggagagagaaagagagagagagaaagagaaagagagaatagatataccagggagactgggagggaacttaatggcatgatcagaagaggctctctgagtaggtaatatttgatttaagccctgtatggggagaagcagctttgtgaaaagctgggaaagaatgctcctggtggaggggacagcaagagcaaagaccttgaggcaggaactcacttggcccattgaagcagaatgaggactgtgtgcctggagtttctggtatgagtgagagatattatcatgtgaaattagaaaggtaagcagattacatagctgcctgtaagccacaggagggttgtgcattttattgtgagacggggaagttttcagcctaggccagcatgatctcttggactcatatttttaaaatatcattttgactcctatttgttgactggactgtagggagcaagagtttataacaaagaagactggctgatcaatgtatgccccatcctcagtctctacttttgctgagacattttgaacaccagtgattcccttttttcccctctacccacaggtgagaaattgagttctgttgcccagcatctgaaggggtgtaagctcattccctacccttcctcagatactgggcattgggataatggtattttaatgactttttcatgattgttaagacttggtgttatatagacaagcctcaaaacacactactagttgaactcatggtatgctccaaacacaataaaacaatccaaaaatcttgtcagagttgaattttagtctgctgaggtacttctcaatctttgaaatggatataacaattgaatttataagattattgtaagcattgaagtcaacgcagagtggcaagcacttaacacagtgcttgaaacataataaaagacttcttgatatgtattggctactattgttacctccaagatattaaaataatctttgaaataacctagccatgacaaaggtatcacaaatagagactgtagtgtgtgggccaatatcatttgtgactattgctacaactatctttaatatgactcaatagaattgtgtattaaaagtgtaatattccattaccaaatatggtttgtttggaaggcaagggcaacattaatattagaaatgctataaatacagcacattacagctcccagattctttttctaacaatgccaatcttgggttacctgtaaacatctcaccatctcacccctagagtatgtatgggaggcattacaattattcccctaaaggattaataactacttcagattagagttcacagcttttaataacattaagaggataaaaatactcctatatacccctaaaaataagaagaacatttaacacgatttttagggttaacagttgttctttcttggtggtaggatcacgtggtatacctcaaatcaattgcagtgtacatctattacttctgtaatcagaaaaatgttgcaattgtaatctcaatattagattcccagctgctgtaacaaattgccacaatcttggcagtataaaacaacagacatttctcctctcacagttctggaggctagaagcctgaagccaaggttttagcaggtccgtgcttcctctggaggcttggggaaataatccatccttgcctcttctagcttgctgtggctgtcggctttctttggcttgcggctgcatcacttcaatccctgcctctgtcgtcttatcactgtctcctccttatctgtctaatctccctgtgcctgtctcttataaagatacttgtgatggcagttggcacccaccaagataatccaggataatcctcttatctcaaaagccttgatttaatcacacctgcaaaaactttagcataaaggataacatataggttccaaggattaggatatggacatatttctggcaaccattatcagcctgccatagtcttgtaacaaaacataaaacacacacacatatatatatatctatatatatgtgaatattatttaaatataattttttaaaaattgctgagccaaagccaatggaatgtttaatagtgacattcctatttacttggggcaataatacaaaaatgaggttcaaagtatttattttatttgacatattctggacaaggagatgagataggaaatagactattgaattaaaggaagtaaatgatggtggtttttggaaaacactattttctataaaaaaaaaactgaaaaagtattagtatttaatgtaaaaatgaccagataaaacattagtttaagaaagccaatgactgtcgtatatgtcttgaaaaactagctattatttaatataacaataaaagacattctaataataagagcagcatcaacatccacaaacaatacccgtcaaaatatgttaatttggcactttagcgatattctctttttatcacagtaatagcatgcccatagtcattgggagaaactagaataaacttgtaggaagacagagtcaccagactggtcacccgtatttacctgtccctctgtggtagttttttttagaggaagggtctgcattaaggactaagtggaaagtcagtccttattttagttagacttgtgagtgagctgaatgagactgattcaaggcagctgataaaagttaattgattgattgacgtattttcctttaaggtgtgaatggctaatagaacaggcaaatagcttaagtgtccttctcctcttccaaccctaagaattatatattttcctcaaacaaaccctcaactggtaatatttaaccagcatgggtaacttttagggggtggaggaggctttttgttaagaaaacatcaacatcattgcttgttatcttgtgttcttcaatgagcagagctgacccagcctcctcttcctcctctcatataagaaagtaactctattctatcttagcctccagctttttggaggttcttccttaagagcctttttagcaaatcttctcagggtctgcctccatttcgtttatttccagacttgctcatatttttcttttagtgattcagcagggaatggcatcaagaaggagcctgttctcaatttgtttcttttccttatgacctaggattgactgtcacatgtaaattaccaggcctgtgaaagccattcaaggtgacatgcagtgatcttggaccacagggcatcatcagccctcagtatttaacagaaaaaaaactgatgagcagccagtgaaggtcactgggcttgaggagcacataaccctcaccatattctttacttttaatttttcttttatttgatttactaatataacatttatatacagtgaaatatatagattttaagtgtacaattcgctaagtatcaatgaatatatgatatacatatgtatttatgtatacacccatgtgactaccactctgatcaaaataaagaacatttccatcaccccaaaagttctgtcagcccctttcagtcagtttctaccttcactccacccaataggctatcactgttcgattgctatcattatagatcaattggcctgttcttgaccttcatgaaaatggagttatatggtaggtaatttttatatccgcctcctttattaaaaggaatgtttttgagagtcatccattctctctaaattttgtgtttgttcaacatttaacaacatggcaaggaggaatatgaaaggtaaatgaagaacaaaatcctaagctctttggaaagacaagccatcgtaaacaaatttggtaaacatccatatgaagatttagaaacacttggttacacttggttaatggtgtggaggattttcattgtcatctccatgaatcagaacttgtggaggtagtggtaacatcagtctgccatcacatgacctgtaatgctgtggccatgggcatattttaaaagctccacttctaagtaacatagttcagttgagaaccactgccctgtaatgaatgtgagatgggcaatatgaatttattgttcttttagcaggttgcaattcctgcctgcttcttttactatgagaatcttgctgtgattttagtatttataaatcatatattcatgcaccatacttttaaaatgcaagttgacaattccatttatttcctttatgaagaaacagtgatctgttttcagtgctggaggaaaaatgggctgtgctggtcactccactgaggaaaattcctgaaggcatgctaaaggtaattttatctttatatgattttcactactttagacagaataggagaaactatgctgtcataacaaattaattttaaaattaataaagatgcattttttgtttaggttacatgtccaatatagattcacaaagcactcagattcccagtctgttcgtttgcagtatgtggattgactggactctaatgtcaccacagaaaggcacagaaggcagaatattttcaagggccaggcccaggaatggtttacatcagctctcaagctctgctgtaccttagaatcatcaggggagcttttaacaatgttagtgccctggctgtactccataccaattaaatgagagtttctggggctgagacgatacatcactgtgttttaaactctcctaggtgattcctatgtgtagctagcttgaagaaccattggcttgtatcacctctgtccttgcttctttggctggactgagtcacatgaccctgacctacactaagggagcctgggaaatgtagtcttcatgggtgcccaggaagaggccattgaaagagaagttggcaaacctatgtctttgtgtctcacacactcattttttaatgttaacttcagaatgtacctccctcaaacatacgcatgtcctcccactctaacaatataagcctcactatggaatggggaggagatgtggattgtcttgacatctcagagatacttgctgttcactctggtcccactcacatttgaagcagggtcctcaataaaggattctaatctttattctaagaacattgggcaccttttaacaaagggaccagtgaaactagatttaattgtttgatcgatgatgtggggcaagtgtggatgggagcaggccagtaacgaggtctgtgaggtcatccaggataagacaatggtggcttgctttcaagtgacacaaatggagatgtatttgagactgaaaaaatgagattatagacctcactacaagaattgcattagttgagcaatgcaggtgagaggtatccatcaggacttatgtgtttccagcacaatcagccagatacagactggtggagtgatggggaagacacttaatccaagtgtaaacaaaagtaaagtgaagaaatggagacaatgcagatagatactgctttgaagaaacatgcctcagaatgatggggtagcgggagaactgagggaattgccttgtccagccatcagtatcatgatatttacttcccacttaactattgatctgcatatatagcttcttgggctaccactcagagagggaaggtggattttaatgttaggcaccaatgtctctccttatacttggcttatgcctcctggccgatccacccttctgtgtgcctgcctgcttggtttaaaatccatatcatatcaaacagccagttaaggaataaaaagtttagaatactcaatagaagagagattaggaaccacactgtactttttttcttttaagttcttttttttattattatactttaagttttagggtacatgtgcacaatgtgcaggttagttacatatgtatacatgtgccatgctggtgcgctgcacccactaactcgtcatctagcattaggtatatctcccagtgctatccctcccccctccccccaccccacaacagtccccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggatgtgaactcatcattttttatggctgcatagtattccatggtgtatatgtgccacattttcttaatccagtctatcattgttggacatttgggctggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccttaaggaattgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgaataggttgcgaaaattttctcccattctgtaggttgcctgttcactctgatggtagtttcttttgctgtgcagaagctctttagtttaattagatcccatttgtcaattttgtcttttgttgccattgcttttggtgttttagacatgaagtcctttcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctacatgatcgtatatctagaaaaccccattgtctcagcccaaaatctccttaagctgataagcaacttcagctaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatcactttcttcacagaattggaaaatagtactttaaagttcacatggaaccaaaaaagagcccgcatcgccaagtcaatcctaaaccaaaagaacaaagctggaggcatcacgctacctgacttcaaactatactacaaggctaccgtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgcttggaaaactggctagccatatgtagaaagctgaaactggatcccttccttacacactgtacttttgactgtgttggcttactcctggctaaagtgttgtggctcaggaaaattcccttgggaatccttgctttccattatggtttaagaaaatgttgtcatatttgagtcaaaatgttgaatagaaatttggaaatattgacccagggaatggcctacttgtttatttacgcttcccccacaacacatataccttaccccccgccaaccactagattaaaaaggcagcaagtctttcttctcaagtctttccagatagtctggtatacagttggttgttcaagggttatttttgatgaattaatgaatgctttgtggcctgaatcaaagaaactttgaacactctctccctgctatactttttgctcaggggctcttgaatggcctgtggataagtcgatgcagtggtgtcctcacagtggctctgtccatacccagtctcccaaaagacaatttttctctactctaacagttttttttaagagttgagatataattcacataccacaaaattcaaccttttaaagtacacaatctagtggttttagtatattcacaaggatgtgcaaccatctaattccactaatccccaaatattttcataaacctaagaagagctccaaattcattatcagtccctcctgattcccactaatctactttctgtgtctatcagtttgcctctcctgaaaacttaatgtaaatggaataataccatatgtggtcttttgtgtttggtttctttcacttagcataatgttttcaaggttcatccatagcatgtataatagtactttatttctttttatggctgaatataatatgttctgctgggcggctataccacatttttgtttattcattcatgagttgatggacctttgggttatttttacattttggttattatgaataattctgcactggctaataggtttagactagttagagtgaacaagtgatcctcagtttatcaaaggctcacaggacagctggggtcaccaatcagtggtgtcttatacccaccagtgagtcacctttccttttgatttattttataaacttacagatgtgctgcttctaggtagaaaggactatcagtgcaacaaaatctcacttaaaatacggtgaacttttatttttaatcaactcattgctaaaggaaaactagaacaaatccaatcagactgcatctcattttgtggacagctgcaataaaaatttctggatttccgggtttccctcagcagggacaggtgggtaggaatctgcccaactccagtgggaggatttgttctttttttagcaggatacaggaagagggaagagaaaaattgttgattgcacaaacgactaaaatggcacttcaattcccccattccatctagtttctggtttcaactgactccccaagtcatttcggtaatacaaaaagttctgcattctatgccgattcattttcagatggatctctcttgaacccaaattattaatgtttaggtcttcccaatgctggacacaccttcccctttgccagcccaagttagtacctcatctctttccttccctcctctgaaaaatatgaaaaggtttgtttcttcagcccgtgtggcattctatgaggcttgatctcaatcattccatcttttctcttcttgaggctgctgcctctgcacagacccagaaggcaggccctattagccatgcacagagactggtgggtgggtatcagtttggagccaagttcctgggcatgcatcacttttgcacattccttgtctgagggtgcaaaattgcacaagcaaactgagctgcccacaactggctaattgcagaggcaatcatcgccccggctccttccaaatgagcagggagcagctaattgtgctcacaattggctgattgagctcacagtcagtaaattgctgctgcaactgtttgtgcatacaattttgcacctgggagtaatcgtgggcgatagggtctaacacactttgaaagaacattaaacagtacaacatctgagaaatctaacactgtccagcctgcttggggaatttgagctgggtaggggaggcatacttcttaaattggagttggggtatctcagaccctgaagtaatgccccagggtgcatgttataactcatagcgctagtcataccacatcatatatctcttacctcacacatgaagctcaccggtcaacctgcaaaacatctcagccacaggagaggtggtagagtatttaccacatgagctctgaactcaggctaccttggttcagatttgagttcttctgtttccttgctgggtaacctttgcaagccttgattttttctcatatgtaagatgatgatgatgaaaaaatgtacctgagtcacagcgttgctgtgtagaaatgagataatgcttgtaaagaatgagcacatagtatttactcaatgaatgtttctaatttttaaaaaaactcttaggtcaaaatttgatcatgactttgacatccaatggagtacctcacactctaattttaggattattgttaatacgctggtgttagcatcaaagaaatttttgttttctctgtaccagctatgtgactgtggccaatttgctttaacttgtctaaatcacagtttagcaatctgtaaaatgggggtagaaatgttatctacccctctagggctgttatgtagattaaataagacaacgtatgtgaaggagttagcacttaataagcactctgtaaatgctagctcttgctgttgtcactactactattattgttataaaggctcctgtgagtggggtgggaccgggcctggagtactggggactttggagccagaatactattatgtaactcatgtccacagtgtgatttgctcctacccactgccctgatagaatggattcttttagatagaacagaggtgtgtgagctttatagcaaattgtcttgcttgggcccttcccaaatctacatgaggggagacattcagccctgtggccctgttccctgtgcttgccttgtcctggttcatttcttggtctctgatagagacaattttatagggttcttactctcagcaagaaaaaagagataaggacaagctttggcaggatccggaaattaatccaggggaggcagacattgtgtctctaaatgtaattgaatcttcctggagtctgatgggggtgggggatggagcatggaccttctgacttttaagtctgtgaggaggtgtggaggagggagggctgctctcccttcaagtccttctttcccatggtcccaacctccttcccttttccctttatgaccaccaccacgtgttctgtccctttgggtgtttctggctcttgcctcagcagcaatgcagggtgcacactccccattccttgctgtctaagaatccgagcatacaggactcttcacagtaaatgggctttactgcgatccggatgcagacagggacaaatggcaaagattttagaatcccagagttctcaccagcattagtctttgctcccaactctcatagcatggttagcttgggctgccataacaaaataccacatattgggtggcttaaacaacagaaatgtccttctcacagttctggagggtagaagcccaaggtcaagggattgtgaagtttggtttctcctgaggcctctctccctgtcttgcagatggccaccttttcactgagttctcacatggtcttttctccgtgtgcatgcatccttggtttctctctatccacttttcctcttcttataaggacaccagtcatgttggattagggcccaccctaaagtcctccttttaacttcatcatctctataaagaccttatcttggaatacagttaccttgtgagatactaggggttaggacttcaacgtatgactttttttgcagggggacacaattcagtgcataacacatgggattcttagaattttcaagaaatattttctctttaggaatgtaacttaatgaacccagaacccagctcaatcattaattagttgtgtgaccttaggcaagacaggcacatgtctcgatttgcctgggagtgtcccatttacctctgttgtcccagtgtagttacaagagcaccccctttcattcttaaatgtatcctcgtttaaataatgaatcgtgtggtcactattcattaactttagctgtcaaaatgaagtgaatgacacctaattcacaaaggtgctcagggtttgcaggggatgatggagaagtacctatcacactacccaatgcttggtaagtatgaatgtctttatactactttcttttttttcataaataatatatttgcagcatttatgattcacaacccttctgacaccagacctgtatgtgttttctacatcaataactagttcttcaactttctggacaccaactgagtgccctacaattcaattcagatctgacactaactacttggagttgcccagatcccacagggtaaaggctcagtcccacaagactgacccccacttcagctgccagtcctgcaacacagtcctacctcccacctgtacttcttaccaactggtataaattatgagttctcatgacccccttcctcagttttaataatttgctagaatggtatcttctaagaataactaattcttcaagaccttatagaattgttgtccaaaaggaagctcaccatttctattagttatctggcgatgggctcatgagtctgaaatttaaggaaaacagtttacttactgaaatttcaggaaaataatttatttgctaatgctggtattagtaagtattagcccaggaacagtcaaatggaagggatgcacaggaaaagctatgaaggtggagcttggagcttccatgtcccctccaggtgcaccatcctcccaacatctcaatgtgttcaccagcttggaagcttagtcatttaaggttttttatggaggcttcatacataggaatgtttaagtcattggccattgatgcttaactcagtctccagcttctctcccctccgcagaagactagggtaaggctgaaagttccaaccatctaattacatggttggtccttccagcaaccaactcccatcctaaagctatgtagaggcccactgagactcaccttattagcagaaagtcaggcacgattgaaagaggcttgtttcaaatagcaaaggacagtcctgttacggctgtcactcaggaagttccaaggttttgtttttgttttgagaagctctgcatcagggacctgggacaaataccaaatacatatttcttattataatctctcccttgtacttacacctttctattcctcaatcccaattcccttggtcaggcaggttcatttttcatgaggaaccgtctgttgagacacggcctagagatgatgacagtgtagactggttagcctggatcagtggtcatacaggctcacctgtgccacagtaaactggcattttaagggcctccagattcagtgagagcccaggtaatggccctcttccatcctagaaaattgttcgtgtccaccatcaatagctggtggtgcacttggatgaattagggctccttggctgcaagtaacagaaataagcctctggattaagtgaaatgaaacagggaaagaccctaattataaaggtagtttatggacttaaaggaaaaatgaagtcaccaagcctcaaaaaggaaagggactagaatgcttcctgtgatctttggttcagggatatatgtaagctcttacttttttaaggggagaaatcaaaaaacaatatacaaagagaaataataaactaaacatcaattttccctccatccagaatcaatagcagttatcattcattttgatgtgtttgtttctggaggagtttgttttttgatcttgttttgctgaatgaatgaaatgaaaccaacttaacttctcagtctccagtcccacttgcctcccctcagtctggagatgaatgttactgtgagtttgtgcaccctttcaggttcagaatcaagagattctgaactttgcttgttcaggctcttgtcccatactctagggacagtttttagaataatttcaggtacctcctaagaataactaattatttaagacctcatagaactgtttctaaaaaataaactcaccatctctattagagttattgggaggtgagcacaggaatatgaaatttaattagttcactgggtcattattcaacacactcaagtttgaaaaccaatgctttagagtggtttctaatttacgtgcatctctgtaaccaatatggtggggcattctctgtcttaggccttctgttagcatggctcatccccaaccagtcccatatctgggggagtgtctgatgtacatgggttgtgccacaggcctgctttcagggccccattatgattttaatggaccttggacaatttcgcctttgtaggcccctttttcccacaatagataaggaaaattatgttttatgattgggttggtataaagttgtatttaattcaggctggattatattcattttttccttctggttttcaaataaatcaaaacactcctgctgggccctaaaagtattgtgggcccaagccccaggcatggtgtgcttaatggagcacactcctgcagtcattcaaggaagaggcaaggcccatgattggcattctcagtcaaatcacacgaagggctgcttttctgatatagtaacacccaacagatgaaatcaggagatttcctcttcaagccctttacatttccattgtggccagagtctcagatctgggtgcagacacaaccctgctacactacaggcctgtcctttgaaattcctccacatccattcctcaagcagtctccagtctgggtcaagctcctggagaggctcatcttcccacctgaactctcaaacatccttggtcacataggattgattaagaattcattcctggagctcctgctgcagaatttcctcctccctgttcacctctgtgcatctctttacttccttgtttaagaaacaagggcaggccgggcatggtggctcatgcttgtaatcccagcacttcgggaggctgaggcaggtgtatcacctgaggtcaggagttcgagaccagcctggccaacatagtgaagccctgtctctactaaaagtacaaaaaattagctgggcgtggtggcacccgcctgtaatcccagctactcgggaggctgaggcgggagaatcgcttgaacctaggaagtggaggttgtagtgagccgagattgcaccattgcactcaagcttgggcaacaagagcaaaacaccataaaaaaaaaaaaaaaaaaaaaaaaaaaaaaagagaagaaacaagggaacaagggctgctgtgtgctgatttctaggcactctgttagttttcttagagctcagagatggatgaggtcatgcctataccctgaaagatatcatggtctcaagcagaaacaggtaatctgatgatgtacgtcatgcacccggcgaagtatgatgagtactggagatctgggagcagctgggggccatccttggttcttgtcacaaggaataagttctctacccttctgctcctctagctagtcctgcctcaactcatttgcaggaggccatttccctgggtctcagcctgtatcacttgacttcttgttcatcaagcaataaatcatatctcatcaattatatgatgcacatattttaaaagccatttaacatttctgtaaatgggttatgattgattgcctcttacaagcactgttggccaggtggcagttgtgacaaaggtgcattgcctgaacatgcatgagtttgatctgaaaagtattgatgcttctgataagatcaggaggatgtctgcaagtaacttgcagagtggggatcagcaacctggaaggacaccccagagactgcagctcgtaaccagtaatattgcatataattttttatgtatgccaaaagtgatagacataaatctaaaagagctttttaataattagaaaataaaatttccaaggcataaggaaatactgtgtcatgatttaatttgtagcatttttttccttaatagtgcttaaaataatgatgtctttaatcaatggtgacacagatttgagaaagtaggctgtatgtacaagtctcacggtggctccatggggacagagaccaccatattttcaacacatagcatagtgctggcatgaaatagatgcttaatatgtatgtgctgattgtctggcattcttagttaaaataacatgtacacagaataaggggaaaaataacaatatgccatgaatagacttagaacattttcctatttctcactgtgtgccttaagtgtacatatcatatgacataacattttctttatagctgggattggcaatattttttctgtaaagggccagatagtaaagattgtaggatctgtgggccatacagtctccgctgccactactcaactctgctgttttagcacaaaagcagccacagacacattatgctaactaatgggtgtggctttattttaataatactttatttacaaaaacaggcacatggcaggatttagtcaatgtgccatagcatgtcaactgctctgaagcatttgttttcaaatttgagtgtgtataataatgactcagtgaacttgttaaaattcagattcctgagcccatctccagataactttaatagatacagtgagcttctttctttttgagcaacacatctataaggtcttgaagaattagttattcttaaaaggtttctgcaattcttctagaaactttctctagagtatgaggcaagagcctggacaagcaaagtacggaattttttaatgtcttatcaagatatcaagattttttttccccttttatttgtatggtgatgtcatttccctttttctttgtatggtgtcaggaggcagccacatattattagggattaaataggagagctagagcatttttttttttaagaagacagatgtctcatcacccatccagggtaaaggacaagtgttcaaaaatgaaattataccccttcaattttatggtcaaaaggagattcctctctctaatggacaacagaagtcccagtagccatgactgagtgcaggctgggattgtgcccataggagaaaccactccagaccaagccttgtctaccaatacagaggctgatgtggttgccacatgtgcagagctgtgcagacccacctcaggtaaacattggattcaaagaaactataaggcatcgctgcaataagcctattagtatggctctctccatggggtgattttcttcttttttagagaatgaagtcctcttagatttgtttgtttgtttaagagacaagtaaatagttttgaaatctctgcgtgagattttaatctggttaattgtctttaaatacctcttgcctgggtatataaacctctttagtactgtatgtggtcaggatgatgcagagagtgagaaattatgtgataatatagtaatgataacatttatctggtgggcacggggctaagaccttgaatacattgactcattctgttctgacagcaactctcaaggtaggttctataattaccctcatttttgcagaggaggatgagaggctctgaatttaggtagctactcaatgtcactagctagtagacattagagccatgatttaagtccaggcattatgactctttatgttgaactctttacctttacttaatgagacatcttactgggatagcacagcaagggtgtccaagaggagaaaaacagaattctcaatattgtgttgactaaaattcgtgatccatgttggataaaacttccaccagcacctcacaccaaactgacatctactccgttggaagatcccaatgggagttgcacaagttatttttttggaaagtcggcagtatggactgaaggtggaaatagggttaggcaagactgatactagagatactagactccagttccagaaatgggacatagggtggtcttgtgagctgagactttgtaagggcagcccccatcctgaaaaagatctgcagtcaggatgggcactgtgtatagccctgggagtgcatcgtacttcacaggaatgtcctcttgcccacatgtacacttccattgctgctgtcttcctccatcatagttgcctggtaaaactccaaccctggttaaatctaatggtctactttctctgaaccagcacccaagcttgttgaaggaaaacacaaccatgttgacaggcgatgcactgtatgattccatttataggacagcctggtcaaggcaaagttaggggacaaaaacagattagtggtttccaggggcagggagtagggctgtctataaaaggcatgagggaatcttggtgggtaatggagctgttctgtgtcttcattatggcagtactggttacatgactgtctgtcaaattacatacattaaaaaaggtggatattactgtatttaagttatatcttactaaacttagctaaaatgaagtctcaagaagcagctgggatacaagatgaagaatcatatcctgagctataagaagaagatgttatcatctttaatattaaagaaaatataatttatattaaaaagaatcttatatggtaaattattgtcctaaagtaaattaactgattgtttaaagaaagggatgtttactacaagtcagaaagttgaggcatgtcaaagattgtctgtgaaagttgtgaaaaatgttataaaagggaacttaggcaagaaatattgtgtaatttaaaagtaattaggcctcctggatgctttataaaatgtcactataactcttagctgtacgacttgcctgccttgcagctaggaacaacctagtatacgtggagttaactgctggaacaagccagaccttatctgcacttctgtctaagtcctagactctacacctagcacataattaaaatcccaaacttaccaaggttttcaacaaaggtaaaggctgctaaaagttaacagaataacatgtatttaaaactattgaagagacagtttatgtgcaaggtgtgtaagaaaagtaaaatatacttttggtaaaaagattataaggaggcatgagaatgtggatttttacctagattaaaagcctaaagaattgttttgaaggtttaagcaagttttaaaaggttaattgtaaaggaaattctgtgcgtaaacatattggctaaagttgaaggagcatcatccagtttttctgcaaattgagcattcaaataaaagcacaatgtgttctcttaaagcactaacctgttctttaacaaaaattataaagggttaaaaagagtctataaaaatcttaccttatggtcaaacattaaaattgggtaaatatgtctaccagattttattaaaattgagtttaatagcacactaatataaaggtgaaatttggcttatctggtataaaatcatacaggaagcattgtcaaatatcaaatggtgtttggctttcttttgactatatttgtataaatatgttattggtatgtgttccaaaattatgggagactcctataattctgataaatcttattgtacattatcagtaatagttataattgttatgttaaaattattatgtgccacagaggtaacagatatccttgtcaattgtgtctttaactatggctaccctaaaactttttgttatccataaacaattgttgtcttgttttggtcctctttagaaggtgtttttttttaaattttcttattattatactttaagttttagggtacatgtgcacaacgtgcaggtttgttacatatgtatacatgtgccatgttggtgtgctgcacccattaacctgtcatttagcattaggtatatctcctaatgctatccctcccccctcccctcaccccacaacaggccccagtgtgtgatgttccccttcctgtgtccatgtgttctcattgttcagttcccacctatgagtgagaacatgcggtgtttggttttttgtcattgcgatagtttgctgagaatgatggtttccaatttcatccatgtccctacaaaggacatgaactcatcattttttatggctgcatagtattccatggtgtatatgtgccacattttcttaatccagtctatcgttgttggacatttgggttggttccgagtctttgctattctgaataatgccgcagtaaacatatgtgtgcatgtgtctttatagcagcatgatttatagtcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccagtgatgatgagcattttttcatgtgttttttggctgcataaatgtcttcttttgagaagtgtcggttcatatcctttacccactttttgatggggttgttttttttcttgtaaatttgtttgagttcattgtagattctggatattagccctttgtcagatgagtagattgcaaaaattttctcccattctgtaggttgcctgttcactctgatgttagtttcttttgctgtgcagaagctctttagtttaattagatcccatttgtcaattttggcttttgttgccattgcttttggtgttttagacatgaagtcctttcccatgcctatgtcctgaatggtattgcctaggttttcttctagggtttttatggttttaggtctaacgtttaagtctttaatccatcttgaattaatttttgtataaagtgtaaggaagggttccagtttcagctttctatatatggctagcctgttttcccagcaccatttattaaatagggaatcctttccccatttcttgtttttgtcaggtttgtcaaagatcagatagttgtagatatgtggcattatttctgaggactctgttctgttccattggtctatatctctgttttggtaccagtaccatgctgttttggttacggtagccttgtagtatagtttgaagtcaggtagcgtgatgcctccagctttgttcttttggcttaggatggacttggtgatgtgggctcttttttggttccatatgaactttaaagtagttttttccaattctgtgaagaaagtcattcgtagcttgatggggatggcattgaatctataaattaccttgggcagtatgggcattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttagctctctgtttgtctgttattggtgtataagaatgcttgtgatttttgtacattgattttgcatcctgagactttgctgaagttgcttatcagcttgaggagattttgggctgagatgatggggttttgtagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaacacctaatttattgagagtttttagcatgaagggttgttgaattttgtcaaaggccttttctgcatctattgagataatcatgaggtttttgtctttggttctgtttatatgctggattacatttattgatttgcgtatgttgaaccagccttgcatcccagggatgaaacccacttgatcatggtggataagctttttgatgtgctgctggattcggtttgccaggattttattgaggatttttccatcgatgtttatcaaggatattggtttaaaattctctttttttggttgtgtctctgccaggctttggtatcaggatgatgctggcctcataaaatgagttagggaggattccctctttgtctattgattagaatagtttcagaaggaatggtaccagctcctctttgtacctctggtagaattcggctgtgaatccatctggtcctggactttttttggttggtaagctattgattattgccacaatttcagatcctgttattggtctgttcagagattcaacttattcccatgtaaaagaacagaaattataacaaactgcctctcagaccacagtgcaatcaaactagaactcaggattaagaaactcactcaaaacccctcaactacatggaaactgaacaacctgctcttgaaagactactgggtaaataatgaaatgcaggcagaaataaagatgttctttgaaaccaatgagaacaaagacacaacataccagaatctctgggatacattcaaagcaatgtgtagagggaaatttatagcactaaatgcccacaagaaaaagcaggaaagatctaaaattgacaccctaacatcacaattaactagaaaacaagagggtggttttataatcagctataaagctctaacaggtgctcttgaatgaaggtttctgttaactggagattgtaacatcaaaatagaggaaaaacattcaggacctttgaagagctaaaatgttcattaatgtcaagcagtacagaaattaactgcataaaatgaactaataggagactggagtaatctttttagtgttttgcttaaaacattgctaatcctttgttttgcttttcaaagtcaagtaaacttttcttttgagctattaacagcttttaacaatttagtatgctcccataaacaaaatttggagcatacttgtctctctcttcctgattttctccagaatttggaaactatctgaatattcttaagttgtcttgggacctcaagaggagagagattcatcaactcataggtatttgatggtaaaaatccatggctgggcttggctttaaaaaggtcttatctcagattccttctacggaacaaaattccatcaaagctaatttaaaaggcctatgtaacaaataattattcttgctgcactgtatgcaaataatttagccaagtataacaaagcaaacctgtcctaccatgatttgtcttttaataaaaatgggaaactagagagagaaaattatgtttcaaaaactatggcactcctgttgttagattctagtgtttttcaatttttattattttgtactgcttaaattaaattctaatttttctggctacaagtttccaaaataagctgtgctttcttaaagccctatgaacggaaaactaggtgtttcagggggtgctgcctctaagtgcccccgatcatcacaggaggaaatgtcttcactgttggtgctgacaactaataactgaaggttcccagaatccttcgtccccatgtctagcgagtccacggaacccagggtaattaaaatggcatctgttacaggaatcaactcctaaatatattgcacgcaagtcaaagcctggaaagctaaggaagcaacccctgacagcccccaaaaacgtcctaaatatcaatgtaaagaaataggaaatcttaagctgaaaatcataaaaaaataagtaactgagtgagaactactcatcttactcagtctcacccctacctctccttttaagccaaatattaaaactttttaatggcaattatttattatgccacccttgtgggaattgccttactcattctactatttgcagtaggcctatatactgtagcaccctcagggtgaaatatcagacaaaaaacgtcaattactctagtattttgcttaattattatcctcatagcaggaataacggttactaacagaaaataacatgtgttattgggcctttcctagcagcacctctgcctgtcattatgtaaaaaatgttgtttctacctctaccaattgggcctagtaagaaacactgctgaaaaagttaaagaaagggctaaaaagctaaggaaatatcaaaacaaccaaataaattcttggtttgaaaacaaaatcatagcatgggtcatcccattcctgggccctctcctaataatatgcctggaactaatgttcttttcctgcctaattaacctttttcaagatttttaactgacagaatcatggccatttcatagacaactaccccaaaacatctacaaacggcatttcccctacagtcaaccggagaccagaaaactctctgtcccctcgtcagcaggaagtagcctaaaagaacacgctgtccctcctcctttttatagctatagagtctggattgacagagcaggagcattgccatcttggacaaacccctcattctaagtttcaccttaataaaaaactgcctaaatccaccagcctaatggctaaagtcagcatgaccataaaccacaaataacatctccaaccagaaacattccaaactcctcccccaccagagacatcctagcccctagataagtcccctccagccgggaagatgctagccccgagataaccccgctctgggccggaaagatgtctgccccaagataacctcccctcgtcccagagagattccaatcccaccataaacttctccacacacataatcattccaagcttgtgataagccccctcaccctaaacccaatatatactcttagtctgtaagagtaagtgctcctgactgaaattggctaggaacacctctcaggttttgtccaaagtaaacctgtctttaactgccagctgtatttcgtgtttctttcctctttctttaactcttacagaagagctttagccatgaaggacattgatgtatttgggagggcaaacatgaacatggtgatgtgaagtgggtctgaggtacacttgccaatcatacctcatccctttgtcatggagtcttgagcctatgggagcaagttgaagtctgtacctcatgtatggttggttgaggtgtagtcagtgctgatttaggaattgtaaaaggctgagttcacagatggacaatgcaaaacagtccagctgaagcagtttgggagaagacagaacctgactgaagattccaagcaagggcttatatgacccagcctccccgtatgagacccagacaattgtcatcagataaggaacaaagactgcgtcagtgattcatgtaaaggagtaatttaagcaagagctctcactgttggagcaatatttctacaggtcaaccaagcgtgaccatttctaactaggaaaatgcctttggataataaactgtctcctatacgcaccatgcagcgaacttgcttcatcttcatcaattaaacactcccaattttctcttccctggtatctgacaagaatctattttctcttttttccatgtaaagagagggtttttggaggctgagagtggtattagtgggatttgatgttggcatccccataattcaagttctcaattgctgttcccactactgcagggcctcaggcaaaacctctaaccttggtttcccccaaatgcataataaagagaagagtctttacttatttatgatgggctctgttacttgtatgagagatgttccaatgtaagtattattacaaggtccaatttactgtccagaaagaagcaatcctgatagaaatctttcatttaattaaaattgattttaaaattgcctgatcaataatgagttaaaaattcatcctggctcagtgggaggagagaggcctccaagcaatcctcactggagtgggttttggctcaagagtgaggtgggccttgccggccctgcttgactggccaaagtctgatgatttttcttgtggtccagacagccaagccctccttgagagcaggaggacatgcaaaagaatctactcttatttcttgcattttgagcagaaaagtttaaaaaaggcaactgaccttgctagttaagcttgaaccatttaacttactggaaaccaataaaaacatttacttattcattttgggggaatggatggtgcatttgcttgaaagctccctcccccagctacagaggcccttttccacatgtgcggtcactccagctggaaaaattgaagctgtcttcccaccctcccatagcctacactcccacatgcaatcatttgctaaattctaccagttcaacctctgcatctctggctcttttccatccccattgctcctgccctgggtcatactgtcttcacctcttacctggaatatttaatagctgtctcactggtttccttggcccacttgtccacctgtctaattcattttccatgctcttacctgagaaatctccttaaaaggtaggtcatcttgggttactgctgctcaaaaatctttggtgatccacattttaataaggaattaagtccaagtgccttggtgggcattccaagacaccataaatcagacctcttgccagcaagtaacatccactgtgtgtctcccaacaggctgccaactctcttctttcctcccatactgtgctactcagcactctgataacatacagaactcttctaggcctctgtggctgtgctcacacgatttccaattccccctaattaaaacacgggtttgttcatttgacaaatattcatttggaaaaggctatgtgcctggccttgtgcaaggctaaaatggaagttagggggaaaagatgtatttgacaaagcccctgctctcctggagctgacatttcaatggggaggtaagctattaaaacaaacacccagcactttgggaggctgaggctggtggatcacaaggttaggagttcaagaccagcctggccaagatggtgaaatcccgtctctactaaaaatacaaaaaaattagccaggcatggtggcaggcgcctgtaatcccagctagtcgggaggctgaggcagagaattgcttgaacctgggaggcggaggttgcagtgagccgagatcacaccactgcactccagcatggatgacagagtgtgactccatctcaaaacaaacaaacaaacaaaaagatgaaaaaatagagatgacggtaagagttatgaaataaatcagtggagccctatggtgagtaacacaatctggggctggggggatccaactaaatagttgggggctgcctttcagagtaagagccgtttacaccgagaaatgaaggatgaggatggggcagacaggtaagacgtggaagaagcatggggcagaggagacagtgattctaagaagtcgaggtgggagggacttcggtgcattctaggaaagccaatgctctgggaacataaggagattttttttttttttttgagaaatgttaggagataaaggtagaatgtcagtgccagatcatcatggctttgtggccatgtaaggggtttccactgtttttccaagtgtgttagtttcttagggctgttgtaacaaagtaccacaaaccgcatgcttaaaacaacagagatttatagtctcacagctctggaggccagaatcctgaaatcaaggtagggccatcctctttcccaagtttctaaggaggatccctccttttccttttacagtgtctggtgtcctgatgtgcttcttggcttattttagcttatctccaatctctgtctctacatgctgctctcccagtgtggtgtctgtgtctgtgtccaaacttccatcgtcttataaggacatcagtcatattgcactaaggaccaccctaattacttcatttcaacttgattaaatctgcaaagaacttgtttccaaataaggtgatgtcacagtcacaggtactaggaattgaacttgaacatatcttttttgctgggggagttgggggtgggggggacttacagtccaacccataataacaagtgacatgggaagcttttaaagagttaggcaacactgttgcccaacttaaaaatataactcctttgatgcctggtgagaaatggagtgaagggtcagatggaacctggagcctagtcttcccgatgtgggatgtgttggcatctgagcctgagataaaagggtgcatacgcatgtgttttggcatgagcacacacgggtagccatcacattctaaaggcaatttccattctgcaccctctgtgatgccttgcaaggcatgccttttctttgtgctttcatagcctttggcttatacttttatttggcctgtgtttagttttaccctgttttagaattatatgtgtagcaggactgtcaggagtgaagacatgtcttttgtaggagggcttttgtctaaataagaaagaggaaaatgcttgcacacacagctgtattgaagagggattgaatagtttagcgatttcacagagagtgactccctgggtcaggcccatggattcatttctgagcattgtggagaacggggaaagaagggactcaggttaaagagcagaaagagccgcagttccatagaaaccagggcacagtcctggtggtgtagggctcagggaacactgttactcagaggggaagagagaggcattcatccctgctgtcagctgaatgtatgtgtcccatcaaaattcatatgtggagacttaatccctaatgtgatggagttaggaggtgattaggtaatgaaggtggaaccctcttgaatgggattagtgcccttataaaagagatcccagagagctcatttgctcttctaccatgtgagaacacagtgagaagagacaatctatgaaccaggaggcatgttcttacaaaacacggaatctgcaagtgccttgatctgggagttcctagcctctagaattgtaagaaataaatttctcttgttcataagcaccccagtgtatggtgttctattataacagcccaaacagactaagacagtcctcctcttgcttatagaatagcttggctgtaaggacatctaagacttctcggatgcattggtatcatgtgtttgtggttttgggatcttcagaagtcaaatgtctaatcgattccagcactctttgagtggacggtggccagcgtgattgtggcaagatggtaccctcatgcaaaatcatgagattctgaagtgccatcagcacaaaagaatgggagaaatcagcttgtgaaatcattcaagaacctcatgcatacctggagaaagatctgggaaagtctagtggaagcttgctgtttcccatgtctagtacatgaacctcttctgatgttggagaaattgcccactgtatgagacttcaggaaaggccctgcctacctctgaccacagagccacaaagcaaggcacaggtacccactgtcccttctttctttgaggttagtccctatggttgtatcatctatgctcagccaatcagaaatactgctccaggactttggaagctatagaagcaaagaagcagtgacagtggagaaactccttcagagtgggtgatgatagcaagggcggtggcagaaacacccattcccatgagcagcggtggtagtaccatgggccttcatgtttggtacagatggagtatggctgtgtgatgaactgaaaaatgggcctccaaagattgtggctgtttccttatatggtaaaatatctgataaagtgaaggatcttgagaggaggagtttatcctacattatccatgtggcccctaaatgcaatctcatgcttccttgtaagagacaggcagagggtgttttgagagagatagacagaggagaaggcaatgtggccaggaggcaggatatggccacaagccaaagaaggcctggagccaccagaagttggaagaggccagggaagaattcttccctaaaacatttggagagaatatggctctgcaacacaccccaattttgaatttctggcctccagaactatgagagaatacatttctgtttttgatccacagagtttgtgataatttgttaaatcaggtacaaaaaacaaatatatcttcctgtttgttttctgggccaggtgatcccaaattcctagcaattctctgagccatcctttcaacaaattttcttttctgcctaaatcagaggcagtttctgttgcttgtcattaagagctgggattgctagagtcaatctttcttgggaggaggggatgacaatgttcagagacaaaaaaaaaaatgctgccccagaacataatctactttgtacccattttctgctgagccctagagaaaaccagcttacaatggccataatatttctgcctccttcatcagccactgctggtgccactccttcatcagtctatgtacatcatcccagggagatcaaaagtacagaacattggttaaccttagccttcagtaaggatgttaattttctcagatatgggagagaaataaggaaggggagagattttgatggggagaacacattgaaggtactaaccccatctggtgtaagtcttctcagaatgctgagcagctccttagaatgtgagtgttgcaggtttgggaccaagatggtgtgaatgagtggctcacacacaccctttcttacccatgcctgtggcagatacgactaatcaattcttgtactctttttctcacaatccttctaaaacagtgatctgaatagctgttctcaattgtttggatgtagaataggatataaaatctattggcatttttagtttgtaggcttgaggaaaggagagacagatagcacagagtaagcaacgggagctgaatgcaggaatgacttagcatctgtgaaggcctgagaggaacatcaggacattgcagtgaatctagtaggtgtatagttataactttctcctgcaggtctgttgggccaaatattgagtccgagcatggtcaatgggttttgttaagaggggaaggtagaaggactagaaggtaaggagacacttacagtgctcttgatatggttcaccaggagtctcctggactttcatgaagtggatggagaatgagagcactttaatataggtttaatgatgcaataatgagaaagcgtgcagggtcaatggaggcaaaatgataaaaggtagagtgcagaaggaagtaacagccagaacatgggatttcaaaacgtgctatcagaggtgaagtagttctgagggatggttgcatatagtcatggccctgtggaggatgactggtgtggggtggggaatggaagatgttgaacttaggagatcaagggaatgcaagttcaatttgctgcatgggtttgcaaagtggacactgagatgaagaggatttgtgtcaaagaggaaaccaatcaccaaaatataaaagaaactcaaacaactcaacaacagtaacaacaaaaccccaaatatcctattaaaaagtgggcaaagaacatttttcaaaagaagatatgtaaacaatcaacagacatatgaaaaaatgctcaacatcactaatcatcagaaaaatgcaaattgaaaccataatgatgtatcatcctactccagaatggctattattaaaaagatttaaaaagaaatgttagcaaggatgtgcggaaaagggaactcttatatactgttggtgggaatgtaaattagtgcagcctctaaggaaaacagtatggagatttctcaaaaaactaaaagaggactaccattgatccagcaattccactcctgggtatctacccaaggaaaataaatcaatatatcaaaaaggtacctgtacttgtatgtttatcatagcactattcacaatagcaaagatatggaatcaaactaagtgtccatcaacagacagatggattaaaaaatgtggtaaatatacataacagaatactagtcagccataaaaaagaataaaatcatcttttgccacaacatggatggaactggtggtcattatcttaagtgaagcaacccaggcccataaagaaaaatattacatgttctcagttttcactggttattaaaaaatctgttcacatgaccatagaggtggaatgataggtaacagagacttggaagggtgagggggtgtgaagggagaggatggtgagaaattacttaatagtataatgtacattatttgagtgatagataccacaaaagtcctgagttggttgctatgcagcctatacatgtagcaaaatcacacaggtacctcataaatttaaacacatttatagatatttcaaaaaaactacagtttttattcaaaattcagcattgaatattaaaacaaagaatatggctaggcgcagtggctcaggcctgtaatcccagcactttgagaggctgaggtgggtggatcacctgaggtcaggagtttgagtccttccagtctggccaacatggtgaaaccccatctctacaaaaatacaaaaattagccaggcatggtggctcacacctataatcccagctactcgggagactgaggcacgagaattacttgaacctgggaggcagaggctgcagtgagctgagatcgttccactgcacgctagcctgggcgacagagtgagacttcgtcaaaaaaaaaaaaaaacaaacaaaaaaaacaaaaccccaaaagcaaacaaaacaaaacaaataatatatagtttgaatacttctatgagtatcagttttttattccttgatttttcttggccacgtttatgatgataaagtataaccgaggtgtcaatatgcgttgtgttttgttttcattgaattctcccctcctccagctctaagaagaaggtaaccagaactctgtatgctttgattctctttgttgttggataagatgggaagatgcctggaagtactctcccaacccattccccattccatgtcaaaaacacatgcacttggtgtttacgacttctgtttcacaaactataactctttgatgtgattgtgccagggagaggagaaaagggagcattagtgagggtcccaacagaaaacagcacacgcacatgggctagctgaatgcatttaatgagggagcaatttacaaaattgtgggaaaggttaaaagaaacaaagaatggtgcagcactccatggctaggaacagagaggagcctttaccagctctagatctgcaaggtacggaagtgattactaaaaccagaaccagccaccagataagagctgtggcccctggtagagggagaagcccaatctgtgatgaccggacaggagagaatctgaggaaataaaacacctacttcactctattcctaccttccaatatggcaccttccattggctgaactcgtaaccccattaaccaaacccaaatcaaggccaggaggcaagagagttggttgatgtggaacttaaaggttagtctccaaatactgagtaggtggtatgcgtagctctggaggggaaatggaaaatatctagcttagggggtgagtacctttttggggtgggaaggagacaaaaaaggaataaatttcccaagacagagcagcatagtggttttgggcttcaggaccagatttagcgggattatgtgcctcagcccctattgtacccaggggtgggacagggtttcacagagcacccagaggctgtattctcagtgccaggtgtcccagcctcagacaacagaacagaaacatagaacaaacccaaagccaagagagctcctgcaggagattctgtgttgcaaaaacaattaatttatctttagaggagaaagactctataatgtgtaaggtcaaatttcccacattctcgcaggattggggttaagaattagaatgaatttgcatttagaaaaaccaagtaactgtatttcctgcatgcttaggatctgagagtgaaatttgtattgattatgctaataaatgaattcaagtataataaaaaagtcttaacagataattcagactaatccaagtgctccttcatgtctgaacctctccaatgcctcagatatgtgtgagtgaaagagggtgcaggcttgggtgcccctcctaagtcggaatgggcctaaaagcagcagagttctttcagaatcttacaggacaatgagacaacaagttatttggtgaggaaagggtcaacactggtctcagattcatccagaaatcagactactccagatagaggctctgccatcaagctggtatttttggttaatcacctgacacgctcttgattctgtctttccctggtttgagcagcggcatcaacagcctcaagaccttgaagtcaaattgtgccattggctaaaagttttgcagagctccactgtgttgtggagagctcactgtcatcccctccagctggcagcccattgtatgcctcatggaatggcttaggtgtcacatactgagatgtgagtgtcatttaaggatgcgaggagagaaggcttgaatgtgcacagagacagccaagaggatagcattagggtgggaagaactgggctttgaatcagagtatgtgggtgcaagtccatgctccagtgctcaccagctgtgtgacactggacgtatcacttaagctttctgagcctctacatctatgagagataggttatgggacttgttcaaatgtacacagatggaaagtgcagcaatccaaattctaactttgatctgtccaatttattattcgttcatcgaaaaatgtttactgaacaagtcattgtgccagatatggggaatatctcctgtcattgagccatcaaggaagaaagagcttaaacaaataataatgagtgtggttagtgctatagagaagcagagggtctattagaagaatataaaaggaagaacagtaaatggggtaaaaaatggtataatttatattctagtagaacactcactattacagctattattatctaagatgcagaaacattttatgcacaaatctattagttataatattattcataataacaggaagttggaaacaacctaagtgtccaaccataggggaccagttaaataaattgtgccaaattgttgtgttatataatagagtcacttaaaatgatgcttattatagtttatgatgttatgggggaaacataccgtaaatgtgtgaaaaatacagagcatgaggttgtttatactgtataatctcatatatacttgaggaaagagcctatgtatgtaatatatgtaaactatataattcacatgtatttgggtgaagagtatgtgaaggaagaacctagatcattctgagtagtggtggaaattataaacaattatttttatttattttttcatacatttcataaattccctagcgaaccaaaggaaaataataaataaaacctcatgcagcactaatgtatttgttgaatacctgctctaatgtcacaagaatttatgtggcccttaggaatacaggagatcataaggtatgtcaaggattcacctaggaggagcccatatgcttgctgggatacacaaaataaacatatgctgcaatagaaaacaagatgatgctaaataataataattcaggcaattcactgagtgttagcataacagcaacttgccttaaatgagcatgtactctacccgagatactgttgtaaatactttccacatgtcatcaccttgcatgatgggaacacacattactccattttatggatgtcataattgagactgagagagttacttagtaactttgctaaggtcacacaactaataagtgatgaagtcagattccaacccttgcttttttaatattaaggctgggctcctcatcattatgctgcaatgcctatgaacagctttctagggaagagaaaagttgaagttggccttaaagaatggtaggatttatagagacacaggaaccacagcagggaatggaacatgggggacacataatttgatattttctgaatacttattgggttcttctctgagctagacgtggggagaattgggtggcctcagccctgctcactgggcacattcattcaatgcatgcttgctgagctcctgctgtatgcccccacacgatgtgcaaggagaaccatggcccccactcttacgaaaaatgcaggctagtggcaggtactgacactaaacataaagcaaaaacaatctgtgaagaaaaataaagctccaattaagaaaagtgaaatgtctataaaagagtcaaaagcagatacgtgtgtcaaggatgaacagaaaggctgggagctggctctgggatctgaattaaaaatgattctcagcttggctaaggatatttggggtccattcacaggcaattctcagaataataattgttaatagggactggaacttaaaacttatctcatcaggatattggcttgacttcatctgaatctcagttacctagtctttacaatggggattataatatctaggttgcagagttgttgcgtgaatgaaaaggatatggcacataaagagttgaccacaatgcctgcagaaggaaaggagccaaagccattgttattgctttagggggcaaagagcaaaaagatggaggtattgtgacttcaaaatctaacttttcttatatgaacatgaattcttttccattggtctttgggtcctactggaatgatatatgatggatccattctttcacagcctatgctctgggaagtgcatatccattgagaaggatttgtgctggtaactgttttctctttttcctcttcttcttcctccacatcctctcccttatgttattattatgtttgcaaagctttatccccttcatatactctctgtccttctctgtaccttataaagtcaacctccatagatcccatcaactggctcccttgctattgtctccaaattgggattggcccgtgggagcttccagctggtgattggaaggaaggagtagggagaggtcagagtgtttcttccccactcccccttggtgtcctgtttctggcaatagcttcctcccattgtgactacagctctcacctgtaggacccttctccaataatacatactccgattattcttgcagcctagggatggtaataactttgcattgcaaatcctgagtaccccttgcttattcccttaactttggcccctgaacctcctatattctggtgatgctgaggatctcacctgagagtgctgctccaggtttgcctgatggtgggcgtgggcagtgggagagaaatcacagcattgacggtcttctcttctccaactcagcaccctgaatcgagttctggtcttgagtgctaattggtctgctctcctgctgaaaagtggccaaagtgaatttgtttgcaatgtgaagggaaccttgagctctggaggcccagtataatgccagtgcttaatggctctgtggagttctgctggatacaaaggagggagaagagagggcatctcttcttccccctaacatctcagcctgtgggagtgattgtatccctgccacttgtctttctaaagaggctgagccgcctgagggctcgaagtcatgcctggtcaacttcttcccttccaggcagagctttgccacctcactcctcaaaaagccacataaaaagtgagatgggattttaaagtggttttatatccctttgtatacgatatggcacatctggaataaggagtgacatggaaatggatgttggtgggcctggtgtacttcaacagatccaacaactggataagggatgacatcactggtattttcccaatatgctctggagttgtaaagaggctgctacagcagcattgctgggggactctttctaaggtccaagtgctctaagaactctgagtagaatatggaaaactgttcttgactgcctggcatgttgactcttcctgttctatagactctgtgtttctggtcataggcatagtcatatgaagctcattccccaggacatgcagatgaatccttgcatgggcctttgatcctaacaaggcaagttaaattccttccctaaattgatgttatgaaaggaatgatctctctggtctcaaggaggcatggaaaaagtcatttgcaatgggaaagcctgagaatgacacatggagaaaagtagatttgaacaatggaaaaggtgactacatagtgaccacactgttcaagtgccctgatgcagctgtatcttaacccctggattttctttttctttttcttctcaaatccttagcttacttgctggctgtttacctactctgagttacagttctaagagctttgacagatacagtgtttctacaaaaaattctatggctagtggagcctgtatagacttaggtaacagtgaatgagccctgactccacccattttatatcaggataagttctctaacttatgtgactctgatcacgaagagcgtccactaggaaagacttgattatcttccaaaattgtctgcaaataaaggtacacaggtaatcccaaatttatcaaagttgctgtagccagggcaacactccttgcctttgcctgcctcaagctaggaggtgatggggactacaacccctaaggtgtcatctgcctttcaggggcaccaggatcctggttcagccaggacgagcatcaggcctgccaaagcaggtattcaacaaactctataaggtttgatcacaactagataaaacaaactaaccaaaatatcttacatagaaaaaatactaggaggaaatgcagtgaagtgattacatatgttttcttttcttttctttctttttttttttttttttttttttttgaggcggagtctcgctctgtcgcccaggctggagtgcaatggcactatctcggctcactgcaagctccgcctcccgggttcacgccattctcctgcctcagcctcctgagtagctgggactacaggcacccgccaccacgcccagctaattttttttgtatttttagtagagacagggtttcaccctgttagccaggatggtcttgatctcctgacctcgtgatccacccgcctcggcctcccaaagtgctgggattacaggcgtgagccaccgcgcccggccatgttttcttgtaactaagaattttttccaatcccctaacaatttttgatattttctaaatgttctaaggtgaacttgtattatatttataatatagaaaaattctcttatgtataaaacaacatttgttaattgaagaaagtgtgaattgtcttccactgcccagaggaaaatgtgagaaatccctggaggaaataagtagagagaagtagaagtccctggttattttttgctctcagagcttgatgtgttgagaattttgtgtcaaggtctttgacctatatcctgaagccttgctctcacctctcaccagtaggatttaggggcaaatggcagagagtgctttgtggattagcaaaatcctaagtggatatttttgcaccacaaattgcatccatgcaggtgtgaggagttggatttctccctgtgcccacttttctattctccttaaagaagatgagctgttaaccagaattagtctctgttctcctgtactctttcaggtttctctcatagggaaggaggaagagtctgtaaggaaggacatcaggagacactttgcaataaggatcatgtcagcggttgaagcaaagcagctgaaacgactcagcctctgataacacatcttctatcagcctatttacttatcctatggactaccctgggacagcagttctgattctaggactcccataaaacccagggcagattcactcagttcctccaaacctctgcctgatcctctcctcccccatttccatcacataattcctcatggtgagaaagcaggttgtgtttatttagataaagatatattactgtaatagaattactaattatgttaaacaactttttccttaaacaaaacattccatggttggggatggaaaccattagtgtgagtaggaggagggaggaggagaagagggaagttgtgtttttctttccccctgatttatgaaggtgtgataatcttggaccgctcacaagttgagcttttccgtggataactggattctgctttgccagctataatttgaagcaaattttgctctaaccaatctcctcctccacattaatgtttattaaaagtcagccacagcacatacagatgcctccaacaccatggccatgcccccagggccaactccaggttattgcaagggaggtgggaactcctacctctgctttgctttcacaaagcatgagcaaaataggaggactggggagggaatctgtagctccgtactgaagtcagcagacaatgctgctttgggggttgttggtattacaaatgttatgtaaggacacagcaatactatgagtctttagtctggaatcccttaggggaatatgaggagaagggactgattactatacactcaacatatgaagctttgggaaccattgtaagcgtttccttttatttcctgcatgtgtctttccttaattttctccactgagaagatcatccttaccatctctgcctacttcattgagccaacagacttgggttggattcccccaaaagcaaacttggagacaaggatgtgggtgcaagcagttgatttaggagggggtccaagaaaacactgttaggggagtagggaagtgatatggtttggctgtgttcccacccagatctcatctgaattcccatgtgttgtgggagggacctggtgggagataagtgaatcatgggggcaggtcttaggtctttcccatgctgttctcaggatagtgaataagtgtcatgagatctgatggttttataagggggagtttccctgcacaaactctctttgcctgctgccatccatgaaagacgtgacttgttccttcttgccttctgccttgattgtgaggcctccttagccatgtggaagtctaagtccattaagcctttttcctgtataaattacccaggtatgtctttattagcagcatgaaaacaggctaatataggaagtaagaaggaaagagaatgagtcaacagagggtccactgatgaacaggtttctgctattggtaactgtgattcattctcactagatatctcagaaagtctgtatagtacaggccttggagctcccaggactgaggactctggggtatcaatctactaacttctgtctatcactgattaagggctgcttctggagtgttagtttcttggcacccctggtctgtcctgcacatgagaacactcctgcagtgagaagatggggtatatgtacttttccctgttcttcccagtaagcacaactaaaaatcctggatattatgtgtaaaacaaatatactaatattctgacaggaggagagaagaaggcagactggctaggatctcaacacctgaggaatgatatgatggtgaattcctttaagcttccattctcccagctgggcacggtggctcacgcctgtaatcccagcactttgggaggccgaggcgggcagatcacgaggtcaggagatcgagaccatcctggctaacacggtgaaaccctgtctctactaaaagtacaaaaaattagccaggcgtggtggtgggcgcctgtagtcccagctactcgggaagctgaggcagaagaattgcttgaacccggtaggtggaggttgcagtgagcagagcttgcgccattgcactccagcctgggtgacagagtgagactccatctcaaagaaaataaaataagaagattccgttctcactcatatacccaagacactgcactgaagaatccagaaacctggaaacacgaacgtgcagattttttttttaaaccatcaccaacaagattattaatatgttaaatgcatcttataaagatgtttaaaaatccataataaaaatatttcaacaagcaaatataaatgtgtctaaaacaaataaaaaataaaaagcctcagaaaggaaagtcacagttagtaaataaaagatacaaataactgccacatgaaaattttagaactgaaaagtatcataccaaaagaaaaagctcaatatatggattcaacagtagaattaagggaacagaggaaggaatcagtgaacttgaagacagaacaatagagaatgctgaatctgaacatcaaagacataatagactgaaaaaaattaacagagccttaggcacctatgacactgtaacaaaaagtctaagatttgtattattagatacccaaaggagaggagaaagagagcacaattgaaaaaaaacttgaataaacaaatagtggctgaaaacttcccaaacttgctaagagacgtaaacatacttaagaaactgagtgaatcccaagtagggtaaacctaaagaaatctatgtctagacacaccaaaattaaatttctgaaaactaaagacaagaaaaaaactcttaaaagcattaaaagcagtcagagaaaaccaacaacttgcctattagggagaaacaatttaaaagatcatggattttacattagaaagcatggaggccagaagaaagtgacagagtactttccaagtgctgcagtgaaagaaccatcaactcggactcctgtatccaatgaaaacaaccttcaggaacgaagggaaaatcaagacactctcagataaagaaaaatcaagataattttttacccatagatgtaatctaaaataaagacaaagggaatttgtctaaacaaaaaagaaaaggataaaagaaaacaaagactgtattaaggtaaaaaataaaagaaaatgtaatagattttccttctcatctttggtttgttgactaaattacatttgttgattgaacaaaagctatgctatctgatgttaatatggttctcatgtatgtaaaggaaacagttcagacaattatgttgtaaatggaaaagggcaagacaacatagaggcaagttttcttcaattcacttgaactcgtaaattatcaacaccactagactgtgataagctatatatatgtttaagaaagctatttttaaaagctatttaaaaagatgcacccaaaaacactatgattaagtcgaaataaaatgctaaaaactgttcaagtaactcacagaaaggcatagagaaaaaataaaacagatagaacaaaacagacaacacaaaataaaatggcaggcttaaagcctaacccatcaataatcacattaaatgtagctatttcaacacaccaagtatgagacaaagattgggtaaatgtaaatgcctcaatataccaattaagagacaaagattgggttagaaaacaagaccaactatgtgctgtctacaggaaactaatttcaaatataataaaataggtaagttcaaagtaaaaaaattaaaagaggtctatgtactatataaatattaatcaaaagaaagcagcagttattatattaatatcagatagactttttaaatcaggaagtttatctctattattattatactttaagttttagggtacatgtgtacgacgtgcaggtttgttacgtatgtatacatgtgccatgttggtgtgctgcacccattaactcgtcatttagcattaggtatatctcctaatgctatccctcccctctgcccccaccccacaacagtcaccagtgtgtgatgttccccttcctgtgtccatgtgttctcatcgttcaattcccatctataagtgagaacatgcggtgtttgtttttttgtccttgcgatagtttgctgagaatgatggtttccaatttcatccatgtccctacaaaggacatgaactcatcattttttatggctgcatagtattccatggtgtatatgtgccacattttctgaatccagtctatcgttgttggacatttaggttggttccaagtctttgctattgtgaataatgccgcagtaaacatacgtgtgcatgtgtctttatagcagcatgatttataatcctttggatatatacccagtaatgggatggctgggtcaaatggtatttctagttctcagatagactttagaccaaagaaaactatcagggacggaaaggcacatcacataataataaaaggatcagtgaatcaggaagacatagcaaacccaaatgtatatacaatgaaaaatagagacataaagtaaggaaagcaacagttgatcaaattgaaagaagaaatagacaaattcacaattagagttggggacttcaatacccctctttaacaaatgatagaacaactggacataaaatcgggaaggacatagaattcaaaaacattaacaaccaacaagatctaattgacatttataaaacattccatccaacaatagcacattatacagatggtccccaaattataatggcttgactcatgactcatggtgtaaaagtgatatgtattcagtagaaaccgtcctttgaattttgaattttggtcttttcctagcctagtgatatgaagtacagtactctctcatgatgctggtcagcaaaccccagctcccagtcagccaaattatgtgggtaaacaactgatactctacagcatgctgtgttgccagatgattttgcccaacaatagggtaatataaggtgttctaagcacatctaaggtaggctaggctaggctataattttgataggttaggtgtattaaatgcattttcaacttaatattttcaacttatgatagatttatcagaatgtaattccattgtaagtaaaggagcatctgtatactttttttaaatgctcacatgaaatgtatataaagatagaacatctcttggatcatagacagaactcaacaagtttaaaacaattgaaattacgtagattgtttttttctgaccacagtgtaatcaactggaaattaaagaaagagataacaaagtattctccaaccacttagaaacaaaacagcatacttctaaataatttatgattcaaagaggaagtctcaagaaaaatttaaaaatacatgggaaattttaaataaaaatataatgtatcaaaacgtttgggacacagctaaagcaatgctgagagaaaaatttacaggactaaacgttttattttgaaaaaaggaaagatttcaaataaatcatctcagttgtcttctcaagaaattagaaaatgaggaataaaataaaaccaaggtgagcagaagaattaagaaattacaaagatcagagtagaaatcaataaaattaaaaacagaaaagcaatagagactatcgatgaaacaaaaaactggttctttgaaaagatcagtaaaattgacaaacttctaacaagactgatggagcaaaaaatagacaagacaaaattaccaatatcaggaatgaaacagagggtatctctacagaccatgcagacagcaaaagaataacaatgaaatataatgaagaacttgacacacaaatttgagaacatagatgaaatggaccattccttagacaatacaaactaacacagctcacctagtatgaaatagataatttatatagcccaataaccattaaaaattaaaggtatatataattaaagccatcagaaagaaatcttcaggttcaagtgttttcactggagagttccactaaatgtttaaacaagatttaatgtcaattctatgcagtctcttccaggaaataaaagagaactgttcccaaataattttataaagccagtattatctggataccaaaaccagacaagaaaggcaaaaaagaaaaaaaagtgttgaccaatatctctcatgaatatagaaacaagttattatgaaatgttggcaaatggagctctgcaacatgtaagaagaattataaaacatggctaagggggggtttattccaagtatgccaagactgttttaatatccaaaaatcaatgtaatccccacattaacatactaagataaaaattgtatgataatattaatggctgtagaaaaagctttgacaaaattcaataaccattaatgataaaaactctcagaaaaacagaaataaagtagaacttccttaacttgctaaagaacacctacaaaaaaatgtttaatgtaatattagtggtaaaagattaaacatttttcctccaagaatgaaagtgagacaaggagttttcttaccactgctattccacatagtagtggaagtcttagccagctcaataaatcaaggaaatgtaataaagagtacacaaattagaaatagatgacatgataattgtcatagaaaatcccaagtaatcgacaaaaaaactgctagacataagcaaattaagcaaagttgcagggtccaagctcaacatacaaaagttaattatatttttgtatgttaacagtaaacatgtgaaaacagaagtttcaagtatcatttaaatcattaaaatattgaagtgcttaggtgtaaatctaacaaaatatatacaggacttgtatgctgaaaactacacaatgctgattaaagaaatcagagaagatctaagtaaatgaaaagacagaccatgttcatggattggaaaacaatatagtcaagtagttactactcctccagttgataagttagtttaacattcttataaaaatcatagcatttttgtatagatattgaagagattatccgaaaacttaaatggaaagggagggtaactagatagctaaaaaacaattttgatgaagtagaataaaactgtaggacttaatatacccaatttcaagccttattatatagttacattaatcaagactctatgatactaggtggagagatagatacaaaaagcagtgtaacagaaaagagaagtcagaaaaaggcccacgcaaatacagacaacagttttcttttaattaaaattctgataaaggtagttgtagattcacatgcatttgtaaaactaacatagagagatcctttgtaaactttgcccagtttcccccaatgataacatttgcaaagctatagtataatttcacaaccaggatattaatattgatacactatattagctttatccagttttatttactcatttctatatatgtgtgtgtgttactaagtttcatacaatttatcacctgtgtaggtccttgaaccccctatcacaattaaaattctaaatagttctaatgccgcaagaaccccttgggttgttgttttataaccacttccctcctgttcctttgaaattccctctctcccatccctaactcctggaaatttagaatatctccactgtttataaaatgtcatcattttgaaagtattatagagatggaattatacagtaagtcaccttttggagaaattcttactcagcagactacccagagttgatgcatatagcaacaattcattcttttttcattgctaaacagtattccattgcatgcatgtataaccattcaccattgaagggcatttgggcagatttcagagtttggctgttacaaataaagctgctgtgaacatgcctgtacaggtttttgtgtgtacagaaattttcagggaagcgcaagtgagatgtggcacaagacagaaggtgcttgagtaaaattatttgaccctgaatctagctatacctgaggtcatcaacattcccttcaacttcttaattgtgagggagtttatatcacttgttttatattactaaaaagcagtcacttatcaggtattcacagtgggtcatctcttatgtctttgccccaaaaagtacaaattactttttaaagaagtttggcccctggaggccaatgaagagttttagcaacataagcctgttacatagaacaggggagaaaggttcctaatgcattttgtacttcattctatagttagcttttgaaaatatttggcataaagtaaatacttactataaatatttggttccaagataaatgctcttggtattctccaaagtctgtggtggccagtagggttcaggaaccctgacatgactccacagtggcccctggaccacggaaaagctgccgatggctgtgatgatctgtggtagctgatggctggtcgtggagagaggatgctgggtgatgacagcactgtcaggggatgatagaccaggtccagggccccatagattgctatgtgagatagtggtgttggctgtcatctgatttgtcattattaagaactgacttttggccaggcctggtggctcactcctgtaatcccagcattttgggaggctgaggccggcgaatcacctaaggtagggagttcgagaccagcctgaccaacatagagaaacccagtctctactgaaaatacaaaattagccaggtgtggtggcaaatgcctgtaattccagctactcaggaggctgaggcaggagaattgcttgaacccgggaggcagaggtagtggtgagccgagatggtgccattgcactccagcctgggcaacaagagtgaaactccatctcaaaaaaaaaaaaaaaaaaaaaaaaagaaaagaactgactttttcaaggtgtcagtagatttggtgaataaaaaaaaggactgacttcattcaggtagagataaactggcacctgagcctctgtccttctggaagagaaattacatatgtttcggaagctcagaataattgagagcaaatttgcatttaacttcaacagaagccagtttggacactgaagtatcaatatataaaaactggagatcatcaataaagaactagaaagatagacatctttatttgcgtatggaacagacactttccaacaaatactaaaagaagatgaatctcaacatttaaaacaagttgatgaaaatagataaattggatgatatcaaaggacaccattacaccagtcagtaaaacacagtaaaaacacagttttacaccagtaaaaacacagtccatgaaataggagaaaatatttgcaagtcatatgtctgaaaagaagtcaatatctagaaaatatagagaactctcacaactcaacaacaaataacccaattaaaaaaattggcaatgaacttgaatagaattttttgtaaaaatggcatataaatgaacaataagcacatgaaaagatcttatcatcactaataattaaggaaatgcaaatcaaaaccccagtgagataccacttcatacccattaggatagctattatcaaaacaataaaacacacacacacatacacacaccacaaaatgacaagtgttggcaaggttaagaaaaaatcagaacccttgaccactgttttgagcactgtttctgggaatgtaaaatattatgtatggaggttccctaaaaacttaaaaatagaattgccatgcgattcagtaattccacttctgagtatatactaaaaagaattgaaagcaggggtttgaacagatatttgtacatctatgttcaaagcagcattgttcgcaatagccaaaagatggaagcagtccaagtattgattgacagattaatggataaacaaaatgtggtatgttcatacaatggaatattatttagcctccaagatgaaggaaattctaacatgtgctacagcatggaggaatcttgagggcattttgttgagtgaaataagcccgtcacaaaaggataaatactaattccacttatatggaatagagtaatcaaaatcatagaaacagaaagagaaatgttggttgccaggggctggaaggaagagaagttattgtttaatatgtacagagtttcaattggggaagatgaagttctgtagatagatggcagtgacggttgcagaaccatgtgaatgaacttaaaatgattaaaatggtaacttttatgttatttattttactaccagagaaaaatagattttataaggttgatatttccataaagttacagttatttcaagacaaatctgaaaaatgcaaaagcaagtagttcccaccatggcattgttcaaaattcatcagaaaaatgaagagccgtttcaggcagctctaaaaaaattctttgaaggtgaattccagtcttcagggaaatctgaagtggctttctcaagatgctgagagaacaaaaggatgagagagtaaacttattattcagaagagaaaaatattaggaaataagaaaggccacatctctgggtggacacctgcaggagctgagtgattgggatcctgctttggtgggggcagcataaatggtgcaaggctggaagccaccagaaaacagagaccatgaaagtaaaaaaagtcacaggcactggcaaggttgtggagagaaaggaagtcttatacactgttggtgggaatgtaaattagttcagccattgtggagtacagtgtggtgatccctcaaagacttaaagacagaagtaccattccacgcagcaattccattactgggtacacacccaaaggaatataaatcattctattataaagactcacgcatgtgtatgtccatttcagcactattcacaatagcaaagacatggaatcaacctaaatgcccatcaatgatagactggataaagaaaatgtggtacatatacaccgtggaatactatacagccataaaaatgaatgagatcatgtccttcgcagagacttgggtggagctggaggccattatccttagcaaactaacacaggaacagaaaactgaatgccacatgtttttacttacaagtgggagctacatgatgagaaaacatggatacatagagggaaacaacacacactggggccttctggaagatggagggtaggaggagggagaggatcaggaaaaataactaatggatgttaggcctaatatctaggggatgaaatgatctgtacaacaaaccctcatgacacaagtttacctatgtgacgaacctgcacttgtacccctgaacttaaaagttgtttttttttttttgaaagaaaacagaggccatgtacaacatgagtccaaatgagttttgaatgtaacaattgatgtgattgagttaaatacttatttaagatctcttgaagaataaagaaattataatttacatgaaattaaccaaaaaagattaaataattgttgcactttaagatcattgaaaagtctctaaactagtaaagctttactgaagtcaagagaaacaaacaaacaaataaacacaggcagaggcaactacttcagaggaagcttccaagttttttcagagttgcatcaaggggagaaaacaaattttcactaaatgtacgatttagagagaatttttgtttttttttgaatttaccctgtaaagatagaaaggaatctttcaaaagcagatgacaagatcagccatgcatgtgataagccaggcacctgtaaatgcaatccaaaatttttccagaaaaattcaaaagaatatgccggctattattgaagccagcttatttcctatgagagaaaaatctcaagaggtgttgagagttctgttgctttaaagacaccttcataagttaagagaatgcatccctgagacaaaacaaattgagaaaggtggtataagttttgaaaagcatccttaagtctccattgttgcaaatggggcatttattagagtcctgtgagatcatgagggaatgctctggaggaccagatcactaaggaaggaggatcatgggctgtggagggatggagatccaggatccagtgcccgctgtgggcagatgccatcctcccaggagaaggaaacttctatcaggtcaactttgttctgacactgcagctccttttcaagagcatgagagagcagttctgttgctcctggaactggtcatggcccagagtctcctttcgatccagccctcccaccagaacagtgtgctgctcacccagtctttgttctctacccagtaccctagtcagatggtagatgtcccagagatattccaaggtacatctcctgagaaggggatacactgaacttccctctatcccaagaaagcttggaagaaactgcctaggggtcttccccactgagggatttccctggctgggcacattctccactagccacaggaaagatctctggaccaaacactgcccacatggtctgaaagcagaagtgagtcatctccaagttgaccctatccccaatgagtagacttctgaagatccagaaccacaagatgtttttttctgtcaactaaaatcattttaattgtttttcttttacttttactgctattaagtaaatggcttaaatataaaccaggtagagctagaattctaaggtaaagttctacgactgtggatcatttaaacatgactcttatgagttagctgcttccattttattctatttttaggtagtgttattacagtagttttcttgttaataaatccacaatataatctgaaacagcaagaaatttgtcttttttctaataataaatttattttttttctcttttggttttattgctattatttatatgtttatataataccttaaatggagatttgatcagattatgacttttaagatagtattttataaatgtagattctatacatgtgaatcttgggattggaaatgacatcagcagccacactgacaagccttgctcttctccatggtgtcatctccatcctcagccactacctagctatgtccagtgacagctgaaattatcacaatggattagaactctccgttccttcagggaagggtcatctggaccaggagaaacaaggtcctctgttaagacccagccctgccgcggattgaccttggacccctgactgctttctggctcagtttcctcttaccactgtcttgtggcagagctgcatgagacttaaacaaggtcatgagcatccagttgtccttcaatctggaacccactgcaggaagcacagccagacttttgagagtgcaagagttttcagacagcacctctccatcctgctctctttctgattcccttcatatcctcctcctcctcccccttctcctctttaccaccaccagcactgttatcattgcctttatttcacttccccacatctgtctctgcacttacttcctttttttctcatgttcaacacatgcactgagcaaatttgtcctcatcccctgggtattattgctggatgtctatcctgcctatatctggacgaatcttattgctggatgcctgtcctgcctatatctggacgaatcttattgctggatgtctgtcctgcctgtatctggaccaatctactgtggccttggggtctcatcaggccatctctctaggcctggaatctggaccatgaaccccagcagtgcctactgctaagttcctacacaaattcagctgcctctagatgcctttgtgcaaactcccatcatctcccctgcaattattttttacttgagatggagtctcactgactttgtcacccaggctggagcgcagtggtgcaatcttggctcactgcaacctgcacctccctagttcaagcgattctcctgcctcagcctcccaagtagctaggactataggcgtacgccaccatgcctggctaattgttgtgtttttagtagagatggggtttcaccttgttggccaggcttggcttgaacttctgactgtgccatctgccatggcctcccgaagtgctggggttacaggtgtaaaccaccatgcctggccttctcctgcaattctgttatagcctccagctccttatccctccctgtctaccttcacaacggtgaagtcagggtaaacttttagaaaatataaaggagatcatgagactctactgctcaaagccctccatgcccccaaatcacactgaggctcaaatctaaacattcaacgaaggtccaccaggctatggataacctggtctttgcttgtctctgtctggcccctccaatccggcttctgactttccttctggaccaataacatgtcacacttacactgcctcagagcctttgcactggctgtttcctctgtctagagtgctttccaccaattatgcatgtggctgcctcccttttctcattgacatcccagcttatattgaatgccctccatctctggcttcctctctggtccccagccttatttatggcttcagactctcatcctctcttaaatcatttaatttccatattattatagtttatatcatttagcccttcttatgacagtcctctaggatagaggttgttgattttagaaaaaaggcaaaattgttgctgtgtttctaaatcattttagtaaacttattaaggtaaatattagtaatattagtaaacttatagtttactagttatagtaacttatagttactaatatgctaatattactaatattagcatattagtaaacttattaaaataccactcattgtttgcactcccctctggaaggtaaggaacagagagtttatcttattcaccacagacactgcctttgtatcttgcacatgagagtcactcacttaagatttgggaaggaagggatacatagaagtgaatccagtgcaaagacctcctgagatctcagatctgtccacctgtcagggcctcccagagcaggttctgtacacctgtgggtgtcttcatgaaatctcaccttggatcctggtgctcctcactgtctgcacattctcggagcatcctcgtgtgtgggtttcaaccagcccccttctgacattccatgcctgcgagtgttaagtctccacattaacgtgattcatacagatggctggggaatcccaaggttgtgggaacagcagaaggagatgctatggaaaaagacatggtacggtggccacaggcctcctctactacagtattgagcagcaaaaggctggtgcttttgtgttaaagagaaagccactggacttcagggacccagtccatttcattgtcttggagagaagatgcagaaatatgcaagtacttacaatcaactgttatctggatttagtaactaatatttatggggtactcactcatgatgcacagagtgctgtataaatgccaggccatcttctagttgtgactacccttatggctactctctaagatggggatggcattcagagaaggaaactgaggttctaacaagctccaaatcacacaatatagacgggcagttgacagctcagagtgcctgggaactaatttcaccttcgtggctctccagcggtgaattttgggtgtgttacttaatgcttaggtctcttgactttctcatctgtaaaacagatgagggttgctgtacaagttaaatgagtccatgtgaaacactcactacacaggaagccctccatagatgttgctgttttttttgttattctactagaagtaaatggcctacttggtattgaatctgagacctctgtccctaaatccactcactttctactctttgaataactgtttttgtttaactgtgtttggtttgttgattgctaaaccagtggaagaacacactttcctaattgaccaggtatgcagatgagatagttttggaacttttgacaagctctggctcattgcagtgacattatttaagttccaatttccagcgaggctggctattctcagagaaatttgattcaattccacaaacacttctcctagtcattaagacacctaccaccagaaacatctggtcaattaaatttaaaacattagtcaaacaagttgttggtattatatggtcagacatctggacaaataaaattttaattgaatgttttgatatcatgtggtctcagtttcaaagccaacccccaaatagaaggcacatacctttactttctatgccaagttgggtgggctgggtttggtatatcaattcacttttaaaaaatttaccaaattgtaatgttacagatatagccaccacgcaattgggattttctacaatagtcctgatttttaaaatattccattcttttgctggccaattgacatgccccagttttttggtagacaatatggtccgtatttgcctggagtcatgagtagaatgcaggaagcctacgttgcaattttggatctggttccatttattctgaaatattcagtgacacatttaacaacttttccccctcaggtttccctttgataacatggaggagtcactttgtattttctaacttaaagggaaggctttctgtagaaacttacgatgttttatacatttgtgagcacacatgtttacatacatgtgtgaggcacatgtagacatactattataatgaatcctcaggaaaccctgtttgccaagccctagtgtagatgaatgacaacagtggcatggattagggttccagcagtggacatacagagtagtgggcagatttgagaggtgttcaggagccaaaattgctggtgtctattaatgcacgagctaagggggcggatggattctgaagaagtatttccactaccaagaaaggcaatgttgggaagaaccttttggtcaacttggtcaacttctccagttccagtagagcaatccagcttcttttgtcatctcctctttatctttcatccagagagcccacataagcactgtttaaatttctcttgacttgtcttactcctttgactcatcgaaaactatcctcgcaaaagaaatttctggcaggtcatgtaatgcaaaaaaaaaaaaaaaaaaaaaaaaaaaaaaaaaaagaactcaaaaacaccgaaaacaaaaaaacaaaatcaaaaaccacttttggacatctgttctgatacagaagccaagagcagggtccgcatggtgccagcgtggcagccgtggccgcatattgcagtcagaatgtgcatggtgccagggctaatgatccgggtttcctgcagagggccgctctgccagccttctaattaggatctgctcagagcagcctgggcagggatgatcacgccttttctcctgccctcctctccctcggttgtcttcctcctatgcagcaatttagcattgtgagcattttttttttttttaaatcctgggccatttaaacaaaggggggaagtaaagcaggtttctccagagatgctggaaaaagggacgagaaaccaaagctgatggcggtggatggatgaagtcccagccaccctccgtggaagggtgcagatctcctttaagacctctttggtgaagagtcagctgaaggtcctccccagcataaggcccagagatccagctgctgctgtgggaggctcagcctgggctcctcatcagtccactggtctcagagggtcatcagcgggaagtgatgagcatcttggaggtcaggccggatgtggcgaacacccactggtggtcaggctgtggtatgtcagggaagaggatgttcctctaacagcctaaaccaacccatggaggaagtttgggaagtcatggattattgtgtgttggttttggtttggacccattaggggcactggcttttagacaacaagtatgggggcgggggaagtgtgttgcatggaggagctttcaaaaggtaataggtaagagtagccctgggccacagcccagaagtcttgaatcatggaaccaagactggaagctaaatttcagcagaaattgtatttgccttgtttactgtgatggctcagtgcttagcacagagcctaccatatggcaggtgctcaataaatgagttaatcaacaaaaagagcatcatcatagtggctacgttctaaggatgtggtgaagattcagtgagatactgggtatcaggtgttcagcaccatggctgcacgtggtcactaccgctagtacaactaaagtcaaacactagtgcaggggtcaggaaatattttctgtaaagggccagatagtacatattttggactttgcaggccatacacttctgtgacatttatggaactttcctgttctagtgtgtaagcaaccatagaaagtaaataaataaattgatgttgctatattccaataaaactttatttataaaaacagactgtgggctgaatttggcctgtggaccatagttgcctgacttctgccttagaaaatgacaaagtcaagggatctgttcttcacagagagggtacaaatgcaaatatgcctagattcaggggaagttcatggatatccatgaggaatagctccagcccgagtaaaccaggtaaatgcaaacacaactaacatagcccctcacctgggagactgatgacaagaaggatgcaaagagcatctgctagcctcctccccacagcttctgagtgccagaaacagaatctacacatacttagttttcactaacccacatcggtttctatgagtgagtagcattcttcttcatgtgtacagaacagcagaagatggaataattagaagcatgtatttatccctgaggttccctcatttgtatattcacatccctgatgatgtttaagacctcaggtcactctagtgaaaattgaaagttgggaggctttgaaataagagtaggcccattagtcactcaacaaaccttgtctcctatctactaggtgctaggcattgtgcctagtggtggaaatatatggttatgatcttatcccagacttggatgagctcttggtctagttgaggaggcagggatgaacagagaattaattgtaacaccatgcaactaatgaggcagtaggtgttacttacatttacatggcagggagtggccatctgggctcagggtgagaatgtgtaagggaccgtttcccaggaggtgatctttgagccccgtaatggagtctcactgcactcatgtacacatactgcttttagaattgatttgttttttctttgcaggaaggatgcaccctaaaaaaatgttgagaaaacagtctaacctagttctcccactaggacattttggaggtaaaggagaaatgccagagaaatgcctctactctggattacacagttggtctgtctctactcaggccttgatgtgaaaaggcagggacagtgaaacactgcgagtagaaaccaactgtcctcttgactcataacttttatattgacttgtaagtcagttcttccatggtggaaaagtaatacagacgttgggcaaaatatgtaatgggatttaaattgtagccttaaaggtagcttaaatgttccatagaaaatgctccaggataggaaaaaaggatcttgtgatcgaaggtttatatttataaaatttgtccttttacaacaaaggataaacagtattttctaagttttttttttcatctgcttccctggttcccccttcaggcccactttaacctcaccattcttgataactattttcaacctaaatatgaacaagtcactccttggcttaacaccatcagtgggagccttttgtccacaggacaaatcctcactcaaggtgctttgttctgtttcttctgcagctccagccacatcaacctaataataacaggcaccagcccatgaattctaccatgggtcatatttctcttggctatttgcttatgtgaccatttgatccctgccataatcctaggcagctgttttataaaggaggaagctgagattcagggagatgcagtaacttgcccaagatcaagcaagttttcgtggaatttaatcaaaggtctacctgaattgaacttctgggactcttctacaatattcttctgcctagaacattcttcatctcatttttttttcctacaaaatcgggcccctttagggtttggttcagacattccttcaactatgagccattctcagtctctcataccttccttttgactttcaataccattttgttgagggggcaggtaatcctcacaacactggcaccattgtattattccaatttctttgcctttctcttccatgtgatacattgggagcatcctgaaagcaacttcattatgtaatctatttttatatgctcaggcctagaatggagacagaactttgaatatgtatcaaatgactatatgactaaaaaataatattctaggatatgtgtatttgggccatacctctcaaatgcagaaataacaacctttaaaactgtgtgctgatggagactggatgctgcatgtagaatgaatgagtattcttttcttgttatgctctttgagtggtgactggagcgaccgactggttggggctggttgtcctgtccagcatctcagaaatctctgaaatccatcctaaatgtctaaatgaagtaaagtggttggctttataagtaatagaagtcaattgtgtttgcagtctctaatgcaagaacggcattagatgactgagatggggctagtgccaagaagtgctgagtgggcaggaggcctgattttcagcctccctctgcatccatttgtgataatctgagtctggcgctcaaccagtcatcctcctaacgaggcttgcatgagacagcctttgcccccagcacagacatatactgaatcaggagttcccttatacagacatttaaaaacacccacacatatgcacacactcactcacattctttccaaatacacattttatcttccttgttacaaacattgtcctaacaggctggcaaacattcagacagaaactgaaatatttagatgaactggggcaccttaactcctctggaaaatgacttttagctgaaaggcagaaggaagctgatattctgccttgatcctgtgactctgagtcattgatgaacgcttgccttttggcttgagggtagggcatgagagctgcaagcaaagattgaaataacactcatgtttgttctacattttacaggggagctggtattgtctcccagcaggaaattagatgatattcactcctaggataataataaggaagacattaacaataaagatgaacatttatttcccaccacattattctaagcattgacagcattaggtgatatacccataatgatcatctgaacatataggtgcttttattatctccatttcacaaaatggagaagccgaggcttagaggggttcacaatttgctcaagatcacacagtcagtaaggagcccagcctgaagtagcatatatatatatatatatatctatatatatatatagatatatatatatatatatctctccacagaacctgtgtattttttttccgtgctcatcacccaggctggagtgcagtggcacgatcttggctcactgcaacctccacgtcctgggtacaagcgattctcctgcgtcagcctcctgagtagctgggactacaggtgtataacaccacactgggctaatttttgtatttttagtagagacggggcttcaccatgttggctagactggtctcaaactcctgacctcaggtgatctgcccgccttggcctcccggagtgttgggattacaggcgtgagccaccgtgcccagccctgggttcttaaatgctctgttttacagagcagggaagctggcctgctcaaatttatttgaacgagattgtgagaaaccatctgagagtgaactcattccatggaaacaggatgtcaggattgtcaagctttgccctacaaaacccttagcagtttcaagtagggggattatttgagggtgcatcctggtgttggaatgttagatgagccttttggattatctttctataatcttatgctgggaacctatgaatgccacaatgacaagtatgactagaaagaattcatactagaggccgggtgcggtggctcacgcctgtaatcccagccctttgggaggccgaggcaggcggatcacaaagtcaggagatcgagaccatcctggctaacatggtgaaaccccgtcctactaaaaatacaaaacattagccgggcgtggtggcaggcacatgtagtcccagctactcgggaggctgaggcaggagaatggcatgaacccgggaggcggagcttgcagtgagccgagattgcaccactgcactccagcctgggcaacagagcaagactccgtctcaaaaaaaaaaagaattcatactagaaaatgtcaggagacatacaggatgctggcaaggctactgtgggggctctgctcccctgaaagaagttgacaataaaaagaggggagggaagggagtcatcctagaacagtctgcccatagccagacatatttatgaagccatcctagatcaaccagctcctggcctgtccccaagctaagtctagactggaaggatggcgcagccaaaccaccaagttatttataaaatcactgttttaagacagtaagtttttgtaatggtatgttacatagcaaaagttaaccgatacatctcttattgcaactctacagaattaaaaaggacaagtattataaatcagaagagggaattgaatatctcagaggattcagtgactttcctaaggtgctaaggccaattaatggcagaataatgactagcagctagggcaattcacaagaagtcttgcaaataaaggaaggtagcgtgtactactccaaaacatggtctgaatcattatcatccctatccttgttttaaacttctgtggaggaaaaagtagccccaccttccagaaaacacaatgtaaatataactgccatcattgccatcttcataactagggaagccataggatttgccctacaaattggactctttgagaataacagggatgctactaataactatgccaaaaatatttatttcccaccacattattctaagcactgacaacattaggtgatatacccataatgatcatctgaacatataagtgcttttattatctccatttcacagaatggagaagatgaggcttatttaagcaagctggctctatggccaccctatctctaactaatatggagagagcactttatgggttacaaacccttttaagataattatatttcattttacaaaaaaaatccttcattgtaatcacaacaccctcattttgctgaaggaaactcttattttcagagaaatgaagtaacttttctatggttcttgacagtaggtaggcatttaataaatgtttatgtttattaaactggatgaatagcagttcagtgggtggatgaatgcatgcatatgtaagaataaatgcaagaaaaggaagcagaaagcctgaccacatggtgttttcaagaaggtgtaaagagaagacagtaagtagctaaatggatgactctcacactgagttccccagaacatcaatgccctccatgacattagtaggtgttctgggaccatcatgtaagcccaaggtcttatgttcagtttgctcatctataaaacgggagtaaactttcatgaaatagaggtggaaggacaacagataatgcaaataatgtgtttagcacagtgagtagtacactaaataagaagacaaataacagcaaatatgtactaatcatttatgttccaggcatcatgcaaatgcagtgtgtggattaacctcattttctcctctgtgtctctctctaagtcaggtaccatttattatccccacttcatggatgaagaaattggggcttacagaggaaagattttgcctaaagtcacacaagagccaatggcaaggtgacccagaccctgggttgccagttacactgctgacctgtctcctgcccagtgaatgacacctgtccttagttttattactatgctttgttaaggaaacactcctcactgtatccacagcactttaaatttggatgggtctcaacccttttcagtcatgtgacccttaacaaaatcaaaactaaatcacatttgagaagcctaaaatgtaaaacaaagtaaaaccagaattgctgtgattgaaccagttacagagccctagagccccccttcctgtgacaactgcataaaaacctttgccctctgtggagcacagtaggaaaatattggtctgaagcatagttgagtggatttgctgcctggcacatctaggcttactgtctccggggaccatagcctgctggttccctacaggatctgaatgcatgtttaagctcagataaagagacccaggaggatcatgagggttgggacaggattgaatagagcagtcatctttctgagcttttttaggtaagacccaggcaatagcctaggctatggtggggttcctggagagtctgtaagaaagatttccaagaaaactcattcttatgaagccaggatttctaaagatagtgctggctcaatggcaatgaggaatgacctcctcttccctcctctccccccaactccaattaagtcattttctttctctccacctgtacctggggttctctccagactgcaggcaaatggtgcattaatcacacagatcagccagtgcacaaggatggtgggaagtggctgatttatgaaccagcccaaagtgtggggaggctgggagtgggtgaggtgggcccagctcggggagcatatgggggctccttctctaggaccagacccatatgctccgctgcaggtccatatgctgtgtgggctggtcccccctttgccaatgtcgaggctgcctgtctgctgtaacgtgcagggagctagatctgccacatgccctgctggcattcaaacacaccctttccaactgtgtgagacatgggggctcttcttatagacaagaagagagctacacttatgcccttgtcaatatgagttattgtcatcaatcttttagaaacagtccacaagaaatgagcaagaccagtttttttttctatttgttagaaaagggaattgagacataatgctagaatcaccaacactatgactggcaataataataaccaacaactattgcatgtacatcaggtcctgagctccattctgatcagtttttacacatattaattaaagacacagagtggttgcccaaggtcatggtttgagcgttagagttacgagttgtattcagatctatgtttgctgccacttcctttaaattgtcattcataatttagtctttccctcactcaatgagcatttatggagcctctaccaccgttagaccctataaaaagggcttaggataccactaagaataaagcagatatgatgccatctctcttgggagacacattttagtggagcaagacagacaacagcaaacatttttaaaaaagttaaacaagaaaatgtgtagttacaaattgcactaacttaaatgaaggaagtaaacaaagggcttggacaagaatggcagggtacctagaacagccagggcagtcagaaaagcatgaagccttcagggtgagagggagctgctggaggggaaaggagctccaggctaagaggttaatgtgtgcaaaggcccggaggagtgaaggagccccagtgctctagggacaagtgcaggagggacagaactaacaagggacagcagagagtggtaaaagatgggatggaaggggaggtttcaggcagatcatgaagggattatatatgcactgggaagttgcttcagagttttcagtagctttgcagtactcacttatagttaatattggtgagtaacagcttagcttgctcattaataatgtgacatcccccagctccctagccgatcccctagggcctttcccatccccagatattttgtagtggcagaagccaactcaagaaacagttatttggataaagatgtgtgctcaactggtctgtatatacctccaagggcaggtattatacttaatgcctagcaatatatgggaaaatatagtagaattcacaggatgtgggtacatttttcaatttaaaaactattactgaatctttaagaccatgtttgctttttagtaagctctaaaataatatcattactctaccccattaagttttactacactaggttagcattctatttttttcctttgtacattttttttctttgaagatatcaatagctttggaatgttttattgttttatcatttctatctttttttaactttccgtcgcagcaagcctgacctcagggaaaagatctattagactgccaagattaaattttatttaaccaacatgtatatagagatcattctgtgttccttatgatctaaatgccttacaggaataaacacatttaaccctataacaagcccataagatcgatactgttattatcacccccattttgcagatgaagaagctgaagcacaaagagattaagtaaaacagcccaagttcctattgccaggaagtggtagagctgggtttgagccctggaagtctgtcccctgtgtctctgctattagtcatttccatccgatggaaatttccttgtgtagaaactgtgcttacaggccataatttttaaccctattgtgcttcgtatgtttcccttgcccactaaagaggattctgacttgacatgtggatcttccctcatcctctgagctctcaggagcctcctgtcaagcagggcagggtttggggtttgttacttagtgtcaggagaaaagggcaaaaggaaaaggtagagtgtggggaggagattgtcagggattgaggagattgcttagagagacagactgcagctgccatgtgtgaggtctgaggatctgtgagactcaaagggaaattttaagaagcattgcggagaagagaaacttcttttgctgacaagtgtgagaagtaaaggcaaaaaggctttcacagttctgaacactgttttattgttatcctgcattctgcaatggatatcactccatgctgagcctggtgagccacatgttacaacagcaaggcagctaaaaacaatgcaattttattttcattttctttctgccctctttctttctctttttctctagctttcccttcctcctttcctctttctctttccctccctccatcctttttcccttccttcctttcaggatccatttttggagcacccattctgtgccagatcttgttcacaccctctgaccttcagaagctcagtcttaatatcatcgaggaaaacatttagactacatacacgtctccggtaatgtgaggacatttgatctcctgcagtcccctggagagctgctactcttttacttggtctatgagcaaagcttgcactttgtcatgcctacgatttgagaatgtgaattcttccacatggcatctctcctataggttctcattcactccttctgaaggcttgggtaaaagacaaattgagaaactgtttcacagtttgcagacttcttaaatatttgtctgtgagtgctgttggacttagtataacaggatttagcaaactcttttctgtaaagaaccagctattaaatattttaggctttgtaggtcattcagtctctgtcacaatatctccactttgctgttgtagtgtgaaagtagctttatacaatatgtaaacaaatgtgcatgactgctttctgaaaaacttcatttacagaagctggcagcaggtggatttggtctgtgggctatagactgctgatccctgtagagaaatttggattcttccgtgcatagacactatcccttgtggatgttctgatccaaccagaggatccctaagtgactgccgggcttgtgcaatgaggtggtggtgtctttaagcttcccaccggcaggccttttcaggtgtttatggtcaggtgataggagacgttgctccaatcagaactggaacacagttgccctaatcttcatgggcatccagtttatgaagggagccaaggaaagtgtgatatttaaaaagggattttggggacgatgctgggtgtgaacacacacctatgtacaaacaatttttcaacatgtttgatgttttgtgtgtcatgagtgggtaaatctatggtgatggtggtgttggctgatccattttcacttgtttacttgatggggacagagaaggagaggtgaaaatgggggcatcccagggaccagagccaaataagatggatgggtggttattcaagatgcaggaaggtgactgctacatctctcctgggaacatagaaaccttactaagagaaatgcatcctgcaaggatagccacaaagggatagcctgtgctgaatctagatgcttttatttaatgcctatgaatgcttttagatggaacatgtatttctagatctccaaattctctccattctcttatgattcatccctgtggtgtttgagtttgcactctgtgaagaccttctttgccacttcctgcacactctttctccagtgtgctttcccttcaaacagccacacctgcaggtgtttcccaaaggaacgcctttgatctatggaaccctatgcccacattgagatgagtgagaagtgccttggaattcacaccctccagggtggcccttaaccaatgactaaggggatgtaggagtttaaaagcttccttgtgtggggtgtggatgatgatgacaactactggggtaacttaccctccagagttccctgtgggtcaggctgctggacttggcatgataatgtactcctgtctgactttgctcacaacccctcttttctttcctccttccctcttccctgcccagtttctcctgggagcatgtccttcataaatcacttgtgcacaaatcctcatttcaggggacagtaatttgaatagtgaggtgcgtgcaagtagtttatctatgcctcctgggtaaggtattcggtgcctagcaccatattggaaactcagtaggatttgtaagatctggctacatctttaaattctaaatccactactgagtctttaagaccatgtttgccttttatagtaagctctaaaatgatttcattactccaccccattaagttttgagacctgtcccaagactcattccctgaagaaaaatataaagagctgctaaggagaggtagaagccaggcagatacttgggccaaaaaatgaaatggttcattgattacaggaaaggaaagaggaaaacaacttaatttagattgaaactcctctcccatttttttctccatgtattagagttaatgaatttgtgaaataagaaagagtggatgaggggaatgctattcaaatgcctgcaaattaatcttcctggattcttcctgcttcagcctccctatcttctccttcaggctgagagctcagaggtggtgggcacatggtgccacccacaagttatcatttgctagctagtatcacaaactagtaaatgttgtatcaccctccctttttctcttttgggtattttttttctgttctcctcactatgaaacatcatattcaggagaagaaagagagagtttatagagtttaatactgattcaaaaagtcactgaaaatcccatttagttatagagagtgatataaaaatatagataaatatgtatttatatttttaaaatggtattttattgatatgtagcatgtgtttcactgggccaatgatattatatttatttatacttttatatatttaaggtgcacaatgtgatgttttgatatatatatatatacacatatggtaaaatgattgctagagtcaagcaaactgacatatccatgtatccatcacctcacatagctaagttctggtgtgtataggaagagtacctaaaatctaccctcttagctaattttcagtatacagtatgatattattaacaaaatctgcatgctatatgttacatctgtagacttaatcattctacatcactgcaaatttggactctttgactcatatctccccattttctcctcctccctgcccctggtaaccgtcattctagtctctgtttctatgtattctcaatttctatgtattcaactttttttagattccacataagtgagatcatgcagtctttctgtgcccggcctgtatcactcagcctatttctctccaggctcatttgtgtggtttgcaagtggcagtatctccctttttataagccaaataaaattttattatatatatgaagattatacacacatacacacattttctttgttgattcaaacacaggttaatttgtttattgggttgtttccacatcttagctattgtgaataatgctgcaataaacataggaacaaagatatctacaaggtgccaatttcgtttcctttgggtatatgcccattggaaggattgctggtcatacggtagtacaagttttaattttttgaggaacctccatactgttttccataatgactgtactaatttacattcccaccagcagtttgaaaagatcctcttctctctacatccttgctaacacttgttttctcttatcttcttgataagaagccatcctagcaggtggcttctcattgtggctttgacttgcatttccctgatgattagtgatgctgagtacattttcatacatctattggccattttcatgtgtgtgtttttttttttttttggaaagtgcctgttcagatcctttgctcatttttaaataaggttatttgttttttgcttttgagctgtgtgacagtggagtcaatgatacttgtgtgtataaaaaggttctgtaatgctgacctggcttatacaatttaaagagaatttctagaatcacattttgatgaattctttattccccaatagtcctaatcttaaaaaagttgccatgaaaggggtagcaatactcagtgtggcacaggagctggcttataccagctcacaagagcctattgttaacttttcaggaattacgcaaactcgtcagtgttacattggtggcttgaaaatggctgtgttggaaatatttacaccatgaacattgacaaaagctttaaatcatgccacacctttcccactccttcccaggagatctgactgtcaaatgtttaccagaacaccactggtagtgcctggacctttcctctgcccacatgtggtgacctttcctctgccatgcctgtggactggctgggttaacagtggggtgtctaggtaagcgtctggatcaggattgttgcaaagggctccttgctttctctccattgtgatctgcataacattcatgaaagtctttcctcctgccagcaggtctgttcttgcattagaaaaggttgtgttcagttatctttctgcacttggaaatacatattttgtgagataaatgaagaaatatttgcagctggtatacttttcctcccaggatatttgaatattttgaagctatggtctcattttgctgagaagagaaagaaagtcagcctgattcctggcttgtatatgagtgctagaactcatgatcatgatggacagacttaaacatgttctttctgccagagcatgaacctcattctatgatgagaataataggggtggttttgaattaggctgttatgagtgagcctatgaatatatgtgaatgcagctaagtagctttaatattcattcattcaacagacatcagcttcatagtgtagattcacagcccagcagggaagagctaggatgtatatgcctattgtctgaatggtacatggcgtgatagaatggagttgaggttttaagtcaagcagacctgtgtgtgaatcttagctctgtaattctctagctgtgtgaacttaaccaagccatttaacttcaattttgtcataagtaggatgacaataataatactcacttttccaagaaaaaaaaaaacaggagcttcctaggcaaagtgggatgaactcatccacaaacaaggaacagcttatacaaaggtgtggaagaatgcaatgtgacaggaatattaaaactggcaactagttaggagacagaatatctgatgttattttttctttaaaaaataaatgacttctggccgggcgcggtggctctcgcctgtaatcccagccctttgggaggccgaggtgggcggatcacgaggccaggagatcgagaccatcctggctaacatggtgaaacccagtttctactaaaaatacaaaaaattggcctgtcgtggtggcggatgcctgtagtcccagctactcgggaggctgaggcaggagaatggcttgaacctgggaggcagagcttgcagtgagccgagatcgcaccactgcactccagcctgggcaacagagcgagactccgtctaaataaataaataaataaacaaataatttctctgtgcttcctgaatcttaaggccacaggctgagaagagccagattttaatttctctaactgtaaatgcttagactttttcctcacccactcaggcttaagccttttgtgcaaagggaaggtggcatccaccattctctcaaagtttgctccacatccactcctttaaggtataggcataagaatgagtaaatgccaagagaacactggatccttccttctcttgggcaaatggtaatgctcccagaggcagaaatgggccttgctttgcattccagacttgccctctgtgaacaggctttgcataaagtgaatgcaatgatagaagattacagacctgcagccagaggtagaagatcaggaggggactggattattggagagctgttctcaagttcagggactggggtccagaatctccagtggctggagggataggcctctgtgtttattcaaaagctccctgggagattcagacacatcctttcactccccacctctctaggtcccttttcttgttcactgaacgcactgatgtggagtgtactgcagggaaaccttgtgctgtagtatttgggaatgctgtcttgaaggggcaaacctggggttcttctttagactttttattcactattctaaacgtgatccgttctcccaaatgtaatattttcccccgagaataaaaacactgaagaagtacgcaaaataaatgtgtccctcccctgaaaattgcctcattgttgagttctttttccttttacaaattctgtatttgctgagcaacagaattacaatgacaataacaaaacccccaaataaagctgtttccatttttcatatttaccgcaggccttgtccatatgtagacataatttttccagtgttactcatagtgtcatataattttatattttgcttgattcacttaacattatattataaacaaatgttgagtttctttgtcgtattcctaacagacattttgactggctgcatactattccatcaagtggatgtaattttatttacttaaccatttctctattattaggtatttatggtatttacaattgtttttaataatacattaaactatcacagaaataaacatcttctgtaatcccagcactttgggaggctgaggtgggcagatcttgaggtcaggagttcaagaccagcctggcctacatggtgaaaccccatctatactaaaaatacaaaaattagctgggcgtggtggcacgtgcctgtaatcccagctactcaggaggctgaggcaggagaattgcttgaacccgggagatagagattgcagtgagctgagatctcaccattgcactccagcctgggtaacaagagcaaaacttcgtctagaaaagaaaaaaaaaaagaaaataaataaacatcttcaacatggcacttttataattttttgtcttgttttaaaatgattatattgagtacaattttcataggtggcaaaatgacctaaaaacatttccaggtacaagtttacagggcaaccagctttcaaacagagatgtttaccagctttgtcaagatattcatcccttttggatttttgctcatgtcaagagatgttattgctaactgcaattgaactagaaaggagatcacagggcaatggaaaacatgctgggccaggcatttaaacacatatagcaaactctcccctgcagaacagaggtgtggcactcgttatagatatccatttaatggatatgacaatttgaacgtagctttgggaaaatcaagagaagccattagggtccattcctgaggaagcagcccgaatgtctatatttgggaggtctgtgaagctctctagagtgtaacaatcacagcactcctatgttgtccagatagaacacaaaggaggtcacaggaggcaatgcacaatgggaaggcaccccagaactgaaaagggactggcaggcctaagaagggagtttcaggctagcaattggggtagcacctctcctatgggaccaggcaagaacaggtaaaaactgcagccatccctgatcctccagctgtactgactcctttgtacatcaacccttcagtgcagatcagaaaaatgattccctccaaacctggttaggttaggaaggagctgctaatttttttgctggcttgtgatctcagtccttctggtcctgtgagaatttgagtgcaaatggctgaactcttataagtctggggctggttttataattatagctcatcttgtgtgtatcttaccttcctctttctcttgcacctgcttcttcctcattgtctattaatttgcttatgcttctctaaccctgcaagattaaaaaaatgaccttacttctctgtttctttgcctttagcttcaaaaatgtcaacatttagatttttttttctatttgtgttccatgagatactgtgcaaaaatgaacaattaaaatgccttctgacagagttgcctaattagatagtagataaagtgtgcaaattctatttctcatagcagagatctcagatgatctttttctttcctctcttctctcccatgtcagaagggtttaatatattgttttctctcttctctttctgaccctatagtggctttcttccaagcagaatagcaccacatgagtgccttgttacagtggacaggaacatgcattatttacaaactctatgctgctcccacaagcagcagttctcaaaagaatttacatttatttcaaactattttgtgaatcaatagaacatatttccttctgatcttttagcaaatttagctgaatgaaacattttaaaaatagagtggtttccaccagggcctgtcggggagtggggggctaggggagggatagcattaggagaaatacctaatgtagatgacgggttgatgggtgcagcaaaccaccaaggcaggtgtatacctatgtgacaaacctgctcattctgcacatgtatcccagaacttaaagtataataaaaaaattaaaaaaaaattagagtggtttcttcacacctatgcataaagataggaattttttcagaaaaatttcagctttgtcattatttaaaatttgtttcaagttgccatttcacttttgaaaatatttacattttgaaaaattgcaaaaatggtagagtttctgtatacccttcactcagctactcttcatgttgatatcttgagtaaccatagtacaataaatcaaaaccggaaaaataacttggtacaatactataatactgtcttctatggtttggtttgtccctgtcaaagcttaaaaattgaccaaaattgaaagttgatgcccaatatggcagcattggagggtggggcctaatgagaggtatttgggtcatgagggtagatccctcaaggatagattaatggcctacaacctgggtgaatgagttctcactcttgcagaagtgagttagttcctgagagtgcaggttgtaaaaacagcctggcttcctcagttttgctctcttgcttcctctctcactgtgtggcctctgcacacatccactctccttctgctttccaccttgagtggaagcagcttgaggcacctgcccagatgcagctgttcaatcctggacttttcacccacaagaatcaagtgttgaataaacctcttctctttataaatgacccagtcttaggtattctgttatagcaaaacaagacagattaagacactgttcctatagtacaataattgtattgtattgtaaagtaactaaactacagaccttatttgaatttcagcagtttttctacttatgttctttatctattccaggatcccatccaggaccccacattgcttttacttgttgtgtccctttggtcttctctgatctttaatgatttcttagtctttccttgtcttcatgacctgacacttttgaaacgtattggttggttattttgtagaatgcccttcagcttgggtttatctgattttcccccttcctgattagattgaggttaggcattttcggcatgcataccacagaagttctggccctttttgtatcaggaggtgcataacgttaacatagcctatcactggtgatgttgactttggaccacttggtgaagatgatgaccaactactatgtttctacaatagtatttttatctgtttaattaataaacatcttggggagaagggaagaaccctgtttaatttcgtttttattaatattaaattctttcctttgcctgtttttccttttcttttcttcttttttttttttttttgagatggagtctcactctgtctcccaggctgaaatgcagtggcacgatctccactcactgcaagctccgccttccgggttcatgccattctcctgcctcagcctcccgagtagctgggactacaggcgtgtgccaccatgcctggctaattttttgtatttttagtagagacagggtttcaccgtgttagccaggatggtcttgatctcttgacttcatgatctgcctgcctcggcctctcaaagtgctgggattacaggcgtgagccaccgcgcccggccatcctttgcctgtttttcttatcttctgaatcttattgatgtccatttgatggtttgaaaatttaagagataggagcatatttagttactatttggaaagttttcatggatgaggacacagtccataggggatatgtgaaaattgggggtaaggacacccaaaggcaccccttgggagcattctggaagaagtcttggaatgaggaagccaaactttgtttctacagaaattcttaacctctctaagcatcaatttccttgagtgtaaaatagggataataatgtccctgcagaggtatggtaaagattaacatcaagtactccctggatgtttcctggtacaatacctggtgcaaagtcagtctcattacatagtaattcccctgactccagggagtcatgtgctcaaataccaacccctactctctaattctgttgtgcatgggaattctttgcttctgtaggcctcttgccagttcatagacctaaactgtgaactacacagagaggaaattgtagtctgcctcctgcagcatgcagccctgactcaaacttgttttaaattcacattggtgaaaaatgggcttgcatcccactgtgaatttaaatacttacaacccaggaagaaacggatcgcatggctcatttatcttgcagccattaattaatggtggttaattgtagttatgagctgttgaattccaggctcttgcacccacacattttctttaatgtgttcagaaaaccatggaggcagtgagttggggactgaaagaaagactgtcccagagaggataggctcacaaccccacccctgctcacttgtttgttaagagagggcctactgctgcaccaaccttctaggcagggggctgtgatcccacaacacactgctttctgggccacttccccacatatttattgtcccctaagttcctgggagggatcttcttagacaaaccctctttgtatttcttctgcaaatgagaagtaaattaacttgcaacaaagaggaaagaactttaataaatctggcagcttgaaagagattgtgatatgaagaatcaggacttgggcaagaatgaaaattatgtttttgaatatttctgttgtactctctggggagaagactgctaaggggtgggacataacctgggacaagatgaatatggatgtttcagaagagaagagcccttgtgaccaccttttagacttcatcagatgaaacttctgtagacatctctgacctcacagctcaggagttatcactggatttatgaatgcgataggcacaattctaagatggttcccatgattcctatcttttggggtgtaggccctgtacaattctctccccttgagtgtggtgggcctcatcaagttaagtgaaccctttttaaaaagggtctagagctccaagacaaaatcatagagatttgaaactacagcaaatgctccccttgttggccttggagaaagaagtgaccaaattgtggagacagagatgtgaccagaacttgcaggtgtcccctaggagctgaaatggtctccagctgggtgctggcaagaagacacctcagtcctacaaccataatgaagtgaattcttccaatgacctgagggagcttggaagtccagctgtacctccagatgaggatgcagcatgctggcaccttgacctccagccttgtgagcctctgagcagaggactcaaccaaaatgtgccaagctattcatgaaaattataaaatgataaatttgtgttattctaagctactaagtttgcagtaatttgttatattgcaataaataacaaatacatggaatttatttcctcatctcacctgggctattatcagtctttatttttttccatttgtgtctttcctccttcacagcacagagcttgtgaagatagatttgtcttcttaaagaccttgaattatattatctcatgctttaaaattgtcagtggcttcacaatgtctacagcaaaaagcaagtcctggttaatctgaatttcatggttcctaagtgcctttgagcctaatttcacactgggtcagttctctcatcctacattccagcctaaagaaactgctcatggccaccttccacaatttctgctcacactgtgcctttgcctatgctaatttctctgctgagtgctttgattcccaaggccatgtactcaactccctattcttcaagtcctagctcccccttggctactgtcacgtatcactcgccctttgaacctcccagcaccacattatacccccagtagttcggactaatatcttcatagtttgtgatctttttgttatgcagaaaattctgtgaataaatgagggtttaactaaccaggctctgtcctcaagatgatcacagttagttcctttttccttttcttttctttcttttttttttttttttttatttgagacagatctctttctgtcacccaggctggagtgcagtggcaggatcttggctcactgcaactctgcctcctgggttcaagcaattctcctgcctcagcctcctgagtagctggaattataggtatgcgccaccacgcctggctagtttttttatttttagtagagacaaggtttcaccatgttagccagactggtctcaaactcctgatctcagatgataggtctttaagaggctcagattatgcattcctccaacatgtaaaagctcatttttgcctcaaggactttgcagcttcgattccctctgcctggaatgtctttacctaagattctcacatggttggtgccttcttatcacttagcacctaaaaatattgttctcctaggaggccttctctgggcactctatggaaggcagcctatccttcccatcacctatccaattgctctgctttattaacttcaaagcagttattgctatttgaaattatctcacttactgatatgtggtttgttcatttcctgttttctcttgatggtcagcaactttcttatcttgctctctgttttatctacagtatctggattattgtagtctctcattcaaaaattgttgaatgaatgaattcaaaaacatgtcacataacaaatattctgtgtcctctcagtttttttctgcttaagttcaatttgtaattcttcatccttaatccatcatagtgagttctcacccacagaagacacatattttgggagattatgtaacatttaataatttaataagacattcataatgtaattattatctttgtggaatgtctcctacagtttgcatccatgtgcacattgtagtggatactgtcatatgctgcctagcttgctccttcacagatgaaacattcagattcctagctgctgaagattcgttgctgatgcctcatagatgattccttcttagggaatttcctttggccaaaggtagttgccttgctctaggaagggacatttacatccaataacttgtcaatgtggaggtacaaagatcttgcctaaataggaaacaattctaaaagtccatcccagctccagaggtccctgtgaaaagtcagctgaggactttactgtaactgtaccatgatctaatccaccttttccttctgcccaattctgcttcttacattctccaaacaatgttgttcctaagggcacttcctaatctgcatgcaaatcctcatctcaaagtcgatttcccagttaacccaacctaagacagttggggccagaaatggctaaggaagaagactctgaaatgggattttggagctggattacccactagccaaccatcaacatcagtgaggtaggggaagtaccgactatccctagaaagaaatagtggtgcgagagttaaaatgtgccagtgaagaactgtgatgtgatactggtagacgataaaacactggtgaatgcaacacctccggattttaagacattcaagggatgcaataatttataaggacaatggaataggatgactgttgctgcggcaatcagtgcattaaaaagagactttaaatgcctgagtgtgactagtcgccaatataacatgaagtgcaaaagtcagagggcctccttggcacacatgaaataaacctctcagctcctacagcttgtaggcagaaaaggctgaaaatcaggtccagaatattagggttgtagatcttcaaagaaggctaaattctcaaccctagcatatttaccatgccaagttaggaccctggtttgttttaatttttggtgttgatgtttgtttttaacaacatcattgggatcttgagacttgaaataagaacaactgagttgacacacttgaaaacctaaaaactccagacctactggaacccactggcctcacagaagtgctctacttctccttcttgaaatctagtgcttccctatgcttgaagatgattcagaggcctttttgtcttgcaagataacatacaccacctacagaatctacccccaccactttttcttgctatcacatgagtaactatgttcaaattacaactgaacagggaaattctgatcctgctaagggagggaatgtcaaaagggctacaggacccaaccaatgcttatcagcaggatcttagaagacatgcatgggactggatcctaagggtgctgcctcaagtaagggaaacataaagttgaatatgggagattttattgagatagagcacatgcctatgatacaggatttaacaccttaccaaggaccccaggagagggtcctaacacactgctgggatggttcttggaaacatggaaaaagccatggccattctaagtaaaccagagatgctagagctgccatgacaagtattcgaagaagaaagcaaaagatcatgctagagggagtatactaaataaggctggaaaactcatcagctaatcctgttccacgggaggatccaaaggacactccagttaccaaatcaataatgtatatgctggtgacaggagcaccagtgttgttgagaagaaacagaggtgggtgcaatgatcacaaagagtggcaaagttagagtggcagctggaggagcctggtttgcagagagttaggggatggttcatagaacaaggtgaccctaggggaaagattgatgggcagctaacaactctaatactcaacgtataaatcaagagatgtcaagaatagatggccaagaggctgagggcaacaattccaattaaaagttatgatcacttacctagtttctggaaatgaaccagttttagatgctaaacccactgatggaagccagtcctcagttggaagttctctgcaaccctatagcaagtatcagtagtgaagatgcctccagtgccttctcaaagggatctatgggtacttacatagattactgtgctctgggaagcaggggaacagagacatttgaaaggtactaggacacgggtggggcgcagtggctcacgcctgtaatcccagcactttgggaggctgaagaaggtgcatcacgaggtcaggagattgagaccatcctggctaacacagtgaaaccccgtctctactaaaaatacaaaaaatcagccaggcgtggtggcgggtgcctgtagccccagctactagggaggctgaggcaggagtatggcgtgaacccgggaggcagagcttgcagtgagccgtgatcgcgccactgcactacagactgggcgacagagcaagactctgctaaaagaaataaataaataaataaaaataaaaaaagatacttggacacagggtatgagttgacattgataccagagattcaaggcattattatggctctctgcctgtcacaagtagggcatatgagaatcaggtaataaataaagacctggccaacgtttatctcacagtgggtccatagtgaccatatacctatccagaggtcattcctgagattcctgcatatgtagctgagatggacatacttggtaagtggtggaactctgcattggtttctgggaagccacttaaacttccctcagccccttgatgaatataatacataaaggaacatattacattgtggcaggaatgacctatattaatgtcacccttttcttggtatccccaagcctctgaatcactcaaaggcttctcctaggctgtagccaggccaggggcacgagctctcatgcaatgcagactatgggccaggaaagcagcctgggacagtcaggtttctgggctttgcattgaatgaatcatattttccagtctttcaaggaatggtgcttgcaatgggaaccaacgtttctctcaactgactcttccactgacttcaagaatgcttgtcctgaatggggtgtgggaactgacccacaaaatccacctattttttttttttttccagatgagaagttgcattaggaatagggaagtgactttgaccagccagactccatctataaggacttgcagagtcaggcaggaattgacttcctctactatctcactctttccttgagtcatcactttccccccttcttttacttacacaaagctaaataggcacagtgactttactttaaacaagtcattcacccattattagacaatttttgtttgttttaattgttggtgttgatgtttgtttctaatccctttgaaacaaaagttcgcttctgtgagctcttatttcctccctggaaccctcattattttgttttctgttgtaaaacaaactaaggacttttaatctagacttcacagatgtttggtattgtcctgggtattttacatattcattttcatttacttctccccctagagttatgagtcagaaattacagccattttacaatgaaagacactgaagctcagagatggtaaggactttatatggagtcacacagcactctatagtggtgcagaactcaaagccacatctacctcatttcaggccttatccactgcctaccaccagccctgcttatcccatactcttctgtagattgaagagtccaacgacagagattacaccttacatatcttggaggtcctgctcactctacccctgccttgctgccaatagagagtctcatatatccaataaaagcttgttgaatggatgcctgcgtgaatgagttatgcaataaatccatgagtgtgtggtaacaaacttcaaagaagctgcacgattgaagtgagatatatctcacttgagcaaagagctcaagaaaaccaatctgaacaggttgggtcacagaaggcatcaaagctaaaatcaccagcagcaggagaatagaaaaagaaagctactgaaaaggaaacaaactgacaagaagttgaggggcagcttcttgaggggatagactgctatgctgcattcctaaggaatgctgagcattggccagtgaagagcaggcacatttccaggctgatgggaccacacaggcaaaggctaggagagagagggcagaagacaggaaacagatcgagaagcgtttagtgtggccagtgtgaagaatgctcagtggagagagaaaagaccaggctacggggcatggaaggttcagattttaccccaagggcaatggagcattattgaaggattttcaatgtggaaagcacctgagaatatatattttagttagatcatttaacttccatatgagtaagagattagattggggtaatattggagcatatgaccctggcctcaagaactagttgttctatactcagaccataatagacttgggtatttgcccacaggaagtgaaggtgaagtaggaggtgggacttgacgccagcagcagggctcagacagggaccaaattaaggactagctaaaacagggatggggcagaagtcactttccaaaagacacacccatcagcgtgccatgtcagtttaccattgccatggcaacacccaggagttcccgcccctttccatggcaatgacccaaggacccaaaagttatcacacatttcctagaaatttctgcataaattgcccgttaaactacacgtaactaaaagtaggtataacccccattttgggactcacctgccctgcatcaagggtacatgcacaaaaaatttcgcagagataattttaatagtgatagccccaaactgcaacatccatcctcagtagaatgaattcagttattgtccagatattgaaatgctatatagcaatgagaaagagggaactattgctacattcagttattgtccagatattgaaatgctatatagcaatgagaaagagggaactattgctacataccaccacatagctagatctccagacatgttgaaaacagcaaaccaccccaaaagagcatgcgattctgcttatgtgtaactcagaaagaggcaaaactaatccatggagattaatcagactacctgttgcctttaaggtggatattgaccgggaaaagacatgatgaaggtttttgggatctggtcatattcatagtctgatctctgtagtagttacatgggtgtaaaaatatgtaaaactttattaagatgtacattgaagatgtgtgtgctttattactgtatttgtgtaagtataaaatacttatccctttggaatttcctctataattactcttggatactatggcattgtagaaaacagtgaactatatcagtaaccaaaaaccatatagaattttcctgagtttgtgcttagtctatgtgtggtggtgctcagattaaaagcaaatttagcatttagtgggaactgaatcagaacgctaaatatatctgccagcttttgctatttcctcagaaaagctcactgtaatttgtgtgtgtgtgtgtgtgtgtgtgtgtgtatactacagctacatgtatggaacatcccctctgagttcttctcaaagttcctcagagggcaggacctttttgcagctgggcgtgcggtagataatagcccagtgcctgagtttctaagtgctgtgagggatgtcagagtctcaaccgagaattatttccttggtgtctcaccctgccctgcctggctcttcccactcagttcctggagggcttttttcagctcagtctgaaagagcacccagctccccagaggaggggcagcatcttgctgtgatgtgagtctaattgtttctagattgagcgtttccgtgggacaacagtcccagccggtgttccctgaattaacatgctcactgaaggattgaagatggtgattaggcccgacagcatcagtttcggtgggacagtcgcagtgccacagagctgcatgggaccgcaaggagatttatttgtgtggaatggagacatatggccggaatcatctgctccctttcctctgtaattaaaacatctgggagcagcaaagggctggaaaatgaggagaaagcagtgaacatctcttcctgctcagctttgaataatccagccatggggctggggcatcagggggtacaagccacctggtataggctggtccaggagttgcaatggcccaaaggccaggtaacttgtaaatgtgacttgggggttttgtttttggtgctttattttattttttcctgaaagcatgtagaattggtttctttctgaagctgtttctaaaatgttttacaaaaaaaaaaaaaaaggctaaatgacaacgaaagtgtagggctcattgttggagcctgatacaggctatgaccttcatctaagagctatacctccaatggatccaatcaagccagtatcaagacccttagcaaagacatcaagcttggaaggaatggtgcctaagggtgtcctttacttttcttagaaggactgggagtgacaatttagagagaaccttcttaggaagagtattgacactatagaccaattctttctctgttggttcactcattaacttacccaccttcccatctatcagcccacttattgctccctctacccattcattcaagcaatgagatttcactgaggttctgcacttggttctgggaaaacagtagtaagaaccctcatatagttcaccttgctttgaatgggacatttataaacgcacaaaaataatcccacatgacccctgctatgtagccaggtatttcatgtcttgtgagcatgcaagggagaagaccggctcctgcctgctccattctgctccttgaatccaataacatctgttgctcaagtctctgttccacacatcacataagagcccagtgccatcagtggaaaagtaaagaggcccgcatttattgagcacttactatgtgcctagcactttacatacttgaactctttgaagtgggcattattctgtccattacacaggtcagctaactgagattctaagtgagaaagggccaagttggcatttgggccttaagggtctaaattgaatgcacatatttttctattttatcgagctgcatgcttccagggcttcactattactgctaataaatactcagccttctgtgaatcctgtgacagttcagtgcctccctgcagtccttcttgcccaggatgttgactcagctatataaacctggtgttgcctcaaatccttttctaagaatccggattcctgcactctacccagcttatgctagccgctctacctgctaggtgggattcttttccatctgtctagactcccctagactgggagtaaatcaaagctatgggtcatgtctacttaatgtctttattatcaacattgagcacaggacttgacagacaatttccacacctgcaaaatggatccaattctaggatctgcttccttgacgttcttgtcaggattaaaggagaaagaatgtgtaagacacctgaaatagtacctgacctattttaagagtccagtgaatgttagctagcaccgttatcacagtttacatgcacaacgaccttgtgaagagaacggaggctcaactctatggggaagagaactgaggctaaagagactgagtgacctgtctgacaacacacagctaaaaagtcatagagctggggtctgaactcaggctgtctggctccagagtctgagttcataatgcatccacttctctgagtccttaacaaaaggtcatactgaatggtccacatatccagaatcacaagggtgtcatacacgtgactgagagtcaacggctttgtggattctccccaccatagccccttttcatcagtatatttatttattccacacatgttgtggggtccacccatttcaggaaatagaccagacagacaatgaaaggacagtagtcacagaacacgctctaagtctttatggagtttacagccttgtgcctgcttgaaatgagttctatttgtaccatgcctttgggcagcagcctgtagacaagggacattttctttattcactcccataaagccctggcagtctcctccaaagtaccactcttcaacacagctaaggtcccagcacctggtaagaggtaatctacctgctcatatgacagaggctcctgtttcaggaatcctaggaatagaccaagagagccctgctcgcatagagcaaaaagccgcacaatccatgttgagcctaaatttgtctccaagattcaattaagaccaatccagttcctgattaaagaatctgacatccatccaagcataaatatttatgcctgataggctttctccttaacagcaaaacaatctacagtgacaacattagaaatatgaatacattcctggtgatgactctattatcagcactaataataacttaacagtttcagcatgtggcatgctgagatgtatgcaaatggggggcacctctgtcagaagcacttgggagtggaccggagggtctgtcacatgccttagttgcagctggtgagacctcatttcgagtacaccggtgccttgtactcatttgccggtataacgctctgtgctcatgtatcactcttcactcaaagatcacaaatcagcttggcaggccctgctagtgcctccgtgaagccaaaacatctggataagaagtgaaaaaatccagtctttcagcaagtcagccagccagccatttttcagcacatatttgtttagtgcctactgtcttagtgggtgtttcatctacatgctgtcaaacatccagatgaaagacacattccttttcataattcatctagaaatttgggtaccagaaagatgcaatgcttttataacatctgcaacatctgttatttgtttaaatgttttggttttcttgtgggcactttttcttggaatcaggctaagtatgtgccagaaggttggagatatctggttctgtcctcatgtttctaacctccaggatttctgaaggtatagataacaggataacacctcatttttctgaattatgctccccaaactataaagattaaatataagttgagatttgtggataaatgacactgtgagcatgcatagctcatgacaatacccataaccctcttacttaactagcaggatacaacgacacattgtgtgtcagcaatggaaatgagggaaagatgctatttatatgtcagaattgtcaaagagttcctgacagatatagttcagaggagaatggattaaagaaggaaccacaggtaaggcaggaatttgcttaagaaggacctggaaaagaaactagcagaaaaacagtatcaatgaacagggatgattcgaagggaagaccacagatatttagggaggcacacccaggccccagcaatcccctgggtggtcatgccaaccactatatatttattcttggaaagggggctgggcagagtatgttgccaatcccagagctgacttccaattgtgtaactgtgcctgtcaaagagggtgggcattgtgtaattaactcttggctgctttcaaatggaagaggagaactgttcaccttgatggtgaaataaagaaatttgtctaacttgaacccccatttccacttgtaccaggctactggacttttgaactgacaatgttaaagaaaagtaaatctaaacatgaagaaagagagatacacactgtctttgccaaaatcgatctcaactccaatctggtacttgagatgagcaaagaggaaattctccaagcatataaaaagataaagaatgtcaaaagaagggggcccatttgaatcattagagcagatttcttcatgttaaacagttaaggaagagaaaagttctgaaaagttagtgtgcatccttaacattctagaagctagttttctgaaatgtgtgaggaagcaggaaataatataagacaagtaaaggctagaggtagatgaaaatataagatttctgactttaaaactgcaattgatcattaactagacaattaaatactcagagcattgtctaatataaatttctgcaatggtggcaatgttcctctatattaagggtcagcaaactttttctgtaaagggctcagtagtaaatatgctaggctttgagggccacatacagtcttatttttttaaacaaaccttgaaatatgtaaaaagaaatccttagcccatggacggtacaaaaacagtttgtggatatcacttaccacttatacgcctgctaggttggctataattttttaaaaaaggaaaatagagagttggtgagaatgtggagaaattggaactctcatacactactggtgagaatgtaaaatggcatgtcctttatggaaaatagtttggcagttcctccagaaattaacatagaattaccatgttacccagcaattctacgtgcaataggaatatgtgcaaaagaattgagaacagatgttcaaacaaaagcttgtccatgaatgttcacagtagcactgctcacaatagccaaaaggtgaagcaaacccgagtgttcatcaacaaatgaataaacaaaatgtggtatttctgtgtaatggaatattacacagccatagaaagaaaggaatgaaatagtgattcatcttacaacatggataaacctggaaaatattatgttaagtgaaagaagccacacacaaaacaatggttcgcatttatatgaaatatccagaataggcacatccacagagacagaagcaggtcggtggttgccagaggttggagggagcacagaacagagagtgattgcttaatagatatggagttttctttaaatatggaactagacagtgatgattgtggtacaacactgggaatgtactaaatgtcactgaattatacagcttaaaatagttaaggtggcaaattttatgttttgtgtatttgaccacaattaaaataaacaaagagaaaatataatatttttaaaaggccatgggatgcatttgactaatgtgttgtagtttaacaatgctgttctctatcttcaccatccactagtagccaactcttgctccatgtactgttgatcacttgaaaactgtgaccaagccacgcttggtggctcgtgcctgtaatctcaatactttgggaggcagaggtgggtggatcacttgaagtcaggagttcaagaccaggctggccaacatggcaaaaacctgtctctacaaaaaatacaaaaattagccggtgtggtggcgcatgcttgtaatcccagctacttggtaggctgaggcaggagaatcacttgaacccaggaaccagaggttgcagtgagctgaaattgtgccgttgtactccagcctgggcaacgagagtgaaacaccatcaaaaaaaattaaatttaaatttaaatagccatatgtggctagtgactagtgtattggatagcatgactgcagaaaactgaataactgaaagagagtaagagtttgataaattctcttaaaactcagaggaaagatacattaaaaaaaatagtgatgaagtgaaaaaggacagatccaggaggaatccaaggaggatggaaagagaagacagaagagagacaatgtcaacaaagaaaggaaaaaaccttttacgtatgaagaaataccttggttagttggatggacttaccatgttagcattatcaacacataataaaaagacagctatgctaagacatagcctggtaaaattattctgaattttaaaattaaaatagattttgctatgagcatccaatgcatggaaataaatagattatttagaaagaaacacacaggagaatgatctcatacttttttggggaatccaaatgatttagaaaaatgattatatagttttgttggagaaaatactgagatttaaaagttttttatctagctaagatgggtgtgtctgttcaaaagcagaagaaagacattttctgaaatacagatgctcagaaagtcaacattcactgaaaagaaaaaaaatttatgtaagtgacctgtagagaaagtttaacatcaatttaacataaaacccatgaatgggaaatcatgctgctaaataattggaggaaaatcactaaaactgtaaaacacaaagtttagtataaataattcctgttactatgtttatgatacaatgtacatgtaaagataaataatgtaaaaattattttatattaataatctaaaaatctcagattacttcaaacttggatatggagaagaaaataatgtaaactcagccaggctgtctcaaatgtgtatgttttgatgtagacttatttaggtcacaagaaactgtttttccagtgctatgatatgctcctaatataggcctcttcacaccaacattttatatcagttttatgacggtgttacaggtgaacttatctggagatactagcagaggtggcagctttctccctgaatttggggatgtttattctatcttaccacaagtttctgagagttaccacaacctcatgaaccaaagtgttctgattttatgagacacctcatagaaattatctggctttgattatttctcatgttctctactcatcaggctaattctcaaattatatatgttttcatgtcttcaggggaaagttaaaagcactatgctctattaattgatcttcactttttaataggtggcctcatccaattgatacagaaaacccaagagccacggaaatagaacagagaccaaagcttttttaacccaaaaaatgacaagaagaaattttaaccacagcaggtctgtcattgtgtaagctaacatcttcatccttcaacttccctaacataaaaagaaaaaaatcattaaaaaagagaatagatgtatcaattatcacaataaatgcaaatggtttaaattattttattaaatgaaaaattaaattgagttaaaaataattcaactttgtacggtttctaagagttatatctaaaagttcatggagaaagattaaaactgaaagtattaaaaaacatttcaggcatatgcaaacaaatagaaaacagaggcagggagttaataccacaatttaaagtacaacacagtaaataggacaaagaatggtttaggttgataaaagttatgatttgaaagtatgctataatagtcttgattcataatattttatatgtattattatctagtgatataaagcaaatgctttaaaaataaagaattttaaaaaaattacatgggagacgaaacaaatactttcattctttcatagataatgaagacaaaaatctatatttttatgaaattttgcattacaatttattaggctgaatatatgaatatataacattggattctataacagaagaaatattcctttgcaatgtctacggaatatttactaaaatttaacatagtcttggacataaagaaatcctcaataatttcaaatgggtagaaattaaacaactcatcttcttttgccagagtacaaattctagaagttaaaaagaacaggtttaaataaaaaccacttggaaattgctgcaagatagaaaatatccttcctcaattaattgtatgaataattaaaagctaacatttagaaaataatagactaagtgcatatcaattctcataggatatagtgctaggcaacacaatcatagcattagtattgaataacaaaggatgaaaataaagaatttaacttaagaagttaaagattagtaaaataagcacaagaatagcataagaagagaaatgaaaaaaaaattctgaaaaaccaaatccaagaaacaatataatttttagattgtgcataagcctaattaagaagagtcaaacacgaacttggaaaactacgattgagatttatatcatagggcagccacacattgaattttttttttttttttcttttctgaaaccaagtctcactctgttgcccaggctggagtgctctggcgcgatctcggctcactgcaacctctgcctcctgggttccagcgattctcctgcctcggcctttcgagtagctgggattacaggtgcccactaccacccccagctaatttttgtatttttagtagagatggggtttcgccatgttggccaggctggtcttgaactagtgacctcatgtgatctgcctgcctcggcctcccgaagtgcacattgatgtttaaaagaatgaatacaatttacatttttctgaacagattaaaaaatcttaattaaaaccgtgattaggttctgggcgaggtgctcatgcctgtaatcccagcactttggatggccgaggcaggcagatcacctgaggttgggagttcgagaccagcctggccaacatgttgaaaccccgtttctactaaaaatacaaaaattagccaggcctggtggcacacgtctgtaatccccgctacttggaaggctgacacacgaggatcacttgaacctggaaggcagaggttctagtgagctgagatcatgccactgcactccagcctgcgtgacagagtgagactcggtcttaaaaaaaaaaaacagtgattggggtagggtaggggatatgaataataatattgattgaagaataattaaacagaatggacacatattaggtggcaagataaagaaatgttttcaaagcatttcttctacataagctcttggctcagaatatagtataggtaaggtcacagaaaactcattgcgcagtgtcacattctttttatgtcctgaaatgtgaattttttgagatatgacatttgagctatatattttggatccctactgctaggcttggcatacattaagtcctcagtgaatacttgttgaatgagtgaagtaatcagtggaggcctgctactgataaatattacttcgaaaaatttttggacagctgttgccaatctttgaaccattgtcatttactttcatgtatcttcctcctttctttgttcatgttattcctctgttggtacagccttcctttggaagggtaaattttgcttgtccctcactacttggtttagacatcactttattttagaaaggtcccttttccaaatcttcttccacactaacctcgccaggtatcctttctctatatcccaatagtatcctgcacttgactgtataacacagatactatttgtgcaattagttttcttcctaatgagaccatatggttcttggaggaccatgactatgttatattaatcttccaactcccagcataaacaatgaaatctaggaatttggaaggactcaaaattgtttaacactgcataattgataggtccattttgttataatagccatctcccctctaccatgttttgcaagattctgtgtaacaaaacaagctatgctgattatgaaatagtaattttattcttcattttttatcaactaaaatatacgtaactatcagagtttttgataaggataggaaatcagaaattccaaaggatgtgataaaaatcttgcctgtgcagctttgtagtggggaatgcacaaattttgcaacatttttttctgaaacgttgactcaagggaatatgacttgatagatattaggttggtgcaaacacaattgtggtttttgccattaaaagtaatggcaaaagccacaactacatttgcaccaacctaatagagttgtaggctctagatttagagtttctttttcttttctttgtaatttttgttgcttgtattaggaaacaaaatatgcaaaagtagagaaaatactatacagacaccagcattttgccttttttttttttttcctgcagagttctctttattttcagaaatgaagtcattatggtttgtcttgtctttcacgtcttcccttccctgcctcagtctccagtatggctaggcatgacagtggtactaatcttgtctttggttaaattttgattttttgttcatcctggatctttttgtgccttaatattgatttgtgaaactttagtttctgattgatccatgttttctactcattagctgtttaaccattggattacttatactttaggcagcgttatcacccaaaaaaatctagccaagaaaagcaaactgtgaggtatttccaaggcatggtaatcatgacgttctcttaaagcatcaggcctgaatccatggcctggctgcatatgttaaagtgctgaggtatgttttctgtctgttcccacatctcaagagagaactcccagccacagacagtgcctggatcccttttctaaggaaactttttcctttccttcatcaaagtttcctatacattaagctgcatataccccattgttctggaaaagacaagccaaaaaaaaaaagattatttcttggaagatgctctgaacttctagagaatcagttctttccatttggagctgaccttcaggtctcagcctctgtttcttttcatgtgcctcttttctcctgagttctagagatttcttgggtaacgaccctatataaagaaacacagtaagtgtatttagttgttgctgtgggacagtcactgtggcaggcaattttcatatcttatgttatttactccctgtaaggaggtagtgcttataacttccatttttgggtttggggaaactggatttcacagtggttaagtaatatgttaaatattgcacagggaggaacagaactggaaggccaaagtattttaacattttgctcctttttgcagatacttgagatccattaaagaatctagagagtgaaataacagaactggagctcttgtttagaaagatgattctggtggaatatggaggatggattggtggagacaagggtgttatgattcacacaagagatcatgaccactgaattaagtcagcagcagtaagacagtggataagagatatgtgaaggtggaggatatagattcatgcagcatctttttggagaagctggttgattctttggtcattgccagcaaagtcatttgaataggaaaggccttggaatcacaaagacctgggcacaaatcttcccctcttcaacttccttgctgtaggacctcagacaagttatatattttttttctgaatatcaatttcattctttgtaaaaataaggataataataattttgtttcctcatgacgtggtgaaaattaaacaagatggataatacatgtaaattctttacataattgatctctggtaagctattgctattataattactttattattattagtggaagaattgaaggagggttaggttgatggcaaccacagggagggaaggccagaacttgatgggatacttgatgttttcttctcttaggcaacagttatgggaaatagggaagaagaagttatacagagaatgcagcagagacaggataaactgaaggagaacaagctggtgacctggctggttccactgtctagggcaaggcaatcagcaggtgttctaggcagtctttcctgaccactggtttgaatcctccatactcctgcatttagctttcctcctctccttacttttggagatctgatgcccaagtttcagatttttctttttcctggactcccaatgctgtttttccttctccccacccagtttcttccctcagttctcctgaagtcttcaaggcccatccacctggttttctttgttcaacatttcactggcattcaatccaaagatatttaagaggcatcaactgcgttgcaggcaggaggaaggaattctctgagccccatggagctcactttctctagaaagatatgtcacattctctccactatgctcaacattgcctggtgtctgtttcaaaaactgccagagccactgatttcagaagtaggggatcttcagaggagggaagggaaatgaaaagtagaaacttctattcataggcttaacaagactttgttactgcacactatataccaggcaccctgctaggaagcagaggcctagagatgaaataaagtagctgtaagtttgctgctctcagaaaatcacattctattggaagaaacagacaaatattaataaacagattaataaagtaattacaaactgtggagcatataaaaggctggggcaaagagaataaaaggggtcagggtttgcaatctgctctccttacactgggtggtagctgtgagagtttggccaaatgcaaatatttgctttccaggtcttcataccaaagaataggtgggaaacactagaccaatggactttagtattttttaatacaccttttatttttgaattactttattttatttattattttcttttagacagagtctcactctgttgcccaggctggagtgcaatgacttgatctcggctcactgcaacctctgcctcccaggttcaagcaatgctcctgcctcagcctcccaagtagctgggattacaggcgcatgccaccatgcttggctaatgttttggatttttagtagatacggggtttcaccatgttggccagactgggctcgaacacctgacctcaggtgatctacccacctcagcctcccaaagtgctggaattacaagcatgagccactgtgcccagcctggaataattttagatttacaaaaaagtagcaaagacaaaggacatagagaggtcttgtatatcatttaccccatttctccaaatgttaacgtcttgcataaccatagtactctgctaaaactatgagattcacattggtacgttactagtagttaaactccaggctttgtatttcaccatctttccttgtattgtacattttattgttattgttgttgttccaggacccagttagggatatcacattgcagttagtctggcatctttttgaacctcaagtattcatgcctctctgagcttatttaacacacagatataaaagcagacacaaaagttgaagtattgcttgcataagatagtctgcaaacacgtatgcaaagaggatcaaaaaaatccttgggaaactgggtagccatcactgccccagccattgatgtcagccaagccttttgcatttttcaattcatctctcctgggcatctgggaaagctcctgcatctcaaagatgtctctctcaaaattaagttctttaagcaaaatgggacctggaatgcagcatttataaattacctatgagggcctgtaaacatcagattgttttttttaatttaattgtccttttaaatatttaattcaaagacagggctgggggacggtcatggaggaggtttacaggatgactcaagaaatgtttcctgtctatcaaatggacagcccgcccagaaagattaacccagattcccccaaagaaatctgtgtcaaattgatgctgagttggtctggcatctgaggggaatcttgacatgacaagattaaccctctcagtgcccccgggctctgagagaaagactttcaaaggtttacctgtgcatagctcagcagaaggtcacatagcactgagttctctgcgtgaggagtgtgacacaggaggaagctgggaatgagtgatgaggaggtgttataactcagggggtatttcccacctgattgcactggattgtcactgatgttttatcacactgtatgcttgctgtgaatttgccgtagagaaagctgctactggcttattacagaccttgcagtccacaatggtgggattgtgacacttcacctgctaccagatgaataatctggggtttgggtccttagctcatgaagggacccttatccactgctaagtaacctcttttctccttggacttttgagtcttgattcatgtctttgtaaacattttcactccaaagtgtgacctcctttcctaatttttgcagaaccattaaaccttcttctgttttttaattgttaacctactcccttttctctagactgtatgaattggcttatcttcttagggcttccctagaagcaacatggataccaaccgcttgttactaaacagaggcttagggagaaggacataaggagatgtgagactgagagatacatagagagaggcctatgggtccaggagctcactattttttggttgtcaaacaaaagttctcaaattactccttcttacattgaggccagtattgagggtccaggatctggccatcagaactcacccaagaaaagcagccctgagattgagttctgatggtgcagtgacaaaggtagttcttgttcaggccactcctttgggttttgtttgtttgtttgagtgaaatttacggtttgtgcacaattggaatggtctttaaccacttactcatttgttactctgcataagtgataaaatctctctccaagtttctaccatggaccagatgaagttagttttgacctgaacatcaagcgtgaagaaaagtaagcatctttagctcccatagcaattgtagttggcatctcaagctttcactatgatgtaacgattaaggtgtcacctatgaaaagaaatatccaggattgttcttaagctctacactgggcacccatggaccatatgtgagctctaggtttgttttgtttgaccacacaggtgaacgtgaatcactctgcatgggacaccacagcccccacctctcctattgttttatgcccaatctgcttcatgtatttgcctcacatgtagtgggttggatagtggatcccaaaaagttatgtccaagtcctaatccctggaacctgtgaatgtgactttatttagaaaaaaggtctttgcagatgtaattaagttaaatatctcaaggtaacatcatcctcgttttagggttggtcctaaatccaacgacaggtgtacttataagagaaaggtagagaagtttaagtggagatggagacagagatcagagtgatgctgccacaagttaaggaaggcctgggaccaccagaagcttaaaaaggcaaggaaggattcttctcccctagagaccttagatggagtatagctctaccaagacttcgattttggactcttgacctccagaactgttagagaataaattgttattttaagcaccatgtttatgttaatttgatatggcagccataggaaatgaatacactcctgcagtcataacacatctgtatttgtttaccttttaatctctgtgtgcttgtgtatgtatatttgtgtctctgtgtatatgatatatgtgagtatgtgtttatcaagtgttgaaggccgtttagactcacacaactgctggtcactattctcctatgctcgtgtcttccttctctggccatctttttcttgtggctttctctgaatctttgtggtacctgtagtttttgtgcatctggtaccccttcttctttattctggtgacagaagccaccactctgatgataataattaatttatgctttgagtaattaattagctaaactacaatgattttgaacacctgataaatatgccatgctctgctagggactgtagttatagtggtgaccaaaaccaggcagtcttttatgattttttgacttatcctctgtagtgggcatggtagacacgttgatgcaccattgagattctcccaaggaaacagagaagcatggtgagcagacaacacctggcttaaggtctaactcagctgcacagaacagcctcacctaaggccacatatttcctggggcagcttacctccagcatgagtgaggcagaaggcaaataatattgttctggagctctctgcccaagagaggcttctgggggcctgaatcacaatttgacttctttctcagcccaatcttcctttctgcccgtgccttccacaggtgttaattcctatgccctgataaatatcttgcactccaaccttcatcttagcatctgctttcagagaatccaacctggacactgggtcagagggcaactgaagcaatgcttattcaaagaaatgggacattgtagtgtgataaatgctccaaaggaaagttccctggtttcttgttctcatgtctacacttggagattgtccctctatctcctacctggatggtggcctaaatgtgggactcaattcctttcttttatttacatacacgcctatacatagccacacagacaaagctgctcatatgcaccaaaattcaccgcaacaatgccttgcacagatagaaggtatttctgaagatttggtaaaatggaagagttgtacaatgagaaaaggcaaatggcttaaaatttaaaaatagatattccagttctttaaaaagtcctcttattatttcttccaacaggggcttagtctattatattcacaagttcctttgattttgtggcttcaacactgtacattattatgccaagcaaaatctcttcttgcctccatttttacttctcaaccctttaaaattacagccccttttcttacacaggtgtattcatttgaaaaacctcacagaactatacgcttaacatctgtatattgtattgtatgcagttataatactccattaaaaaaacctgtgcctcctcaggcccatagaaataagtggctatgcaacctactattaattatacctttactatccaatggtctagcaaggctttcgagattgatttctctttattgatatctgattacattcttggggaagatggcattcttttccctcatttgactcatggctcatggggtgaggtgggttatttcttctggcaatatttgcttatttcagagcaatttttgctacactgtgagctctttgaggggaggagctatgtgtccttgtttctgtgtcacctacaccttgcatcaagcctgaaccaaagaacagtctcagtggacactgaacgcaaaaactaatcaattgataaatagaggaaggaatgagtcctaaaaaaatgtgtaggccatgggaccatgaatggagacatagccaggaatttgtatagctgtggcttgggtcttgagtaccattagggtccagatgatttgggttggaacatgagccacactagaaacactcagagtttgacccatatcacgcggccttctaatggtgatccctgttgctccctatagtcaaaagattcaccttcatattcagaactcttcttcatcaacttcatagtctctatgcaggttattaacattcataaaccattcagacaattgctcattcattccttaataaacttttttaaagctaaacatactaagaacttttatgaccttgtgtctttattcacattgtgctctttatgcaaaattcccctttcctatgtatttcctacaaatggttgttgcaaagcacatgggtgttgaagtcctgaagatctaggttcaaattctaagttggccactcatgagctgggtgaccttgagcaaatcaccttaacctttctgaaactcaaattcctcatctatagaaggcatagtagtggtatgaatgataattatttcacatggttgttatgaggatgagatcaggcaacagatttaaacatatttgagaccctggcaccagaattctacaagttcagggttctgagagtgaatatcttcataaatcttgcatcctagtcacctgtcttacctcagtctagactgggacctgcctggaacataatagttgctgatttcttcccccctctctctcttttttctgtttcctccagcataaataattattacaaattatattgttattagtctagaccagggattaaaaactgtggcccaagggtcaaatccagcctggttatgtaaataaagttttactggaacacagttatgcccatttatatgtgttaaaacttattgctttgtgtcatatacttattatggtttcctggcttatgcgcctaatggtgactacagatgttcttttcattttgttatggaatgtttcaagcaactatacttttgcttaagttgaacccacggtgggaaacatttatgctcctttcatatcagcaagagcagcctcctttcccttttctcttttaaattcaaatttatcaaccacctaaatctagtcaccagatttgtcatagagaggcttcctataggtttgggacctttgctcaaatcagtacttttaagccattattagattgtgataaaaagggagataacacagggcctgatgcactgacaatgagcagagcagcagaaatgtgagatgccttctggttggcttcctgctgcttacttggcccgcttgcctcaagggaatcattctcaaactttctgtttcaccatgtgatagaaatctcattacatctcaagagcctattttgaaacttaaatcataagggagaattttaatgagctgagctttgcttaagctgcagagttgagtttggcaatatgttggttgagattgtcatggggagttatctttctggtttcaacaatcagaaaattattgggtcatggttctgggagcttctggcttctttcttacataatattgacaagctacactttgattagcattcacaaaagcatcacaaaaccaaatctgtataagtaggctgtccttttacatcctcaggtgaggaaaagcctaaacatttccttctgttttttagtcttccttcataggtcctttatgatttttgtttatttttgataagaattaaattatttactaaagtttcaaagagctggattcatagaatagggcctgagtgcttcttttcttgtgtctgaaggcagagatgaatttctcatgttgtagctagcaacaacaatttgctagctgactatatttcaggaaggctttgaaccaacaagcaaagactagctagctttgagtccaggggattagagcagttgaaaataatttttccactggaggggaaagtcagtgacttactcttacaactgttttaactcaggtttattgagtttgttaataaatctagttgaaaagcccacattctctatcttagtgtttctcagtgtgctctgcagattagctatactggaatattctagagggaacttgttaaataagcagatcctatggacctactccttactcagtgaaccaaaatcctgtgatgaagttaggggaggggatgttgaaaagcggtataattctataagttaaacaagatctctgggtcattcttctatttattaatgtttgagaaccaatgatgagtaaaatattctctttttattgctcacagtggagtttctaaaggcaatatgtacaaagtgctgcagcataggactatgcgagatggcataaaaagacagaagatggaccactgagatgacctgtcaattcattgattgtcttactacagttggctgaattgactgaaactccatctgctttgttggcacatagacaagactttattggtagaacgttgagagtaattggtttcatatgatttttagataccatcactaaggacttttgagtacgttttgtaagagactttcaggagttgatacaagaagggaaaatgagctcctgggcacctctttcacatgtagtgaagtaactcactccagccttctcctgactttcactgaacccctgaaggagtcgactgctttgctatggggctgaaagctggtattcatgtatattaggcaattcttgccccagagaactttcaattcagctgcataaataaagtaactacaatttgtaaaacctaaaacctattatatgttagtcaatgcaaaatgccagatgagtagaatagattatgaatttaggggcccagtgaaaggtgacattcctgttttcctgaggacaagaggttgtaggaaaaaggtcaaaggatttaagaaatattttttggatagtaccttagttatagttctccaaagaaacagaactaataggaaattggaaaccaatagaaaatatatatatataggtgtgtgtatatatgtgtgtgtgtatatatagaaaacatatatactatatatgttaatatatatgatatatatggtatataaatatatagtatatatagtatatataaatatatagtatatatagtatatataaatatatagtatatatagtatatattaatatatactatatatagtatatatagtatatattaatatatatgtagtatatatattttctatatgcttgtgtgtgtgtgtgtatatatatatatatatatatatatatacacacacacgtatacatattttctattggtttcccatttcctattagttctgtttctctagagaattgtaactaatgtactaatactatccaaaaaacaattcttaatcctttgacatatatatatatatgtcatgtgtgtgtgtgtatatatatatatacacacacatacatatatgtaatatatataatacatatatattatatataatataatatagaaaccttggagcttcctggatctgaatgtagatatctctccctagactttggaggttttcagctatattttgagaaataatttttctttaactttctctatctcttctttctctagtaatcctataatacaaatatttgttcacttaatggtatcccataagttctgcaggctttcttatttttttaaattgttttaccaccatttgactgggatattttgaaacacctcttgactggggtattttgaaacacctgtctccaagttcagaaattctttcttttgcttgacctagtccgtttttgaagtgctcagttgtatttttttatttctttcattgaattcttacctccaagatttttgtttggttcttttaatgctgtctatctttttgttgaatttttcattcagatcatgaattgttttactgatttcattgaagtgtttctctgtattctcttatatctcgttgagtttccttaatattattttgaattccttttcaggcattttgtacatttatttttctttgcagtctgttactgcagaattattgtgattctttggaggtgtcatgttttcatctctctcatgtttctctctctctctctctctgtctctcttcagagcacatatgtgtagccaaccacgatccctggtggactgaacaaagggggccaacgtgggaataaaagacaagagagtatatttggaagaaggggtcgggggcttcttgcctatagtggacaaaggccctgagctttttcagccctctgaatttattaggtaaaagagataatgagaaaggtggggggtgatttttgggtaattgtcagtcagccatttggttcacagcaggcttgcgagactgcatcctctgaacaacaggcactagatttcccagtagataacttcaagaagcctggcgccagggagtaatggccctcagcaaacctcctggcagcaggtgcagtcgtgagtttgctcacatcctgcatttatgataaacagtttgctgtttgatcatatagcctccagtggaatgtggagttggtcacaatccctttggcctttttggctcccaacacatatggcccatcaaacttttcccatggggggctgaaactatacctcctataattatttactggctgtgggctggcataggaagaatgtgccccagatatgcagctttgtgcagttgaggcaaatgctaaaggagccacttccaagggcgggggcaatgagtccttctttgcagagggatctgggaagctcatctttctgtcccctcactataattttagttcactgctactgtatagagcagtggtccccaagctttttggcaccagggaccagtttcatggaagacagtttttccacaggtcggggtcgggtggtaggatggtttcaggataaaatggttctacctgagatcatcaagcattagttagattctcataaggagcactcaacctagatccctggcatgtgcagttcacagtagggtttgcaatcctgtaagaatctaatgccaccactgatctgacaggaggcagagtgcaggtgataatgcttgctcatctgctgctcacttcttgcttggaggttcagttcctaatgggccacagacagcaccagcttgcagcctggggattggggaaccctggtctatagtaatgcaaaacatattgcttccatgtttctgaggactgaccatcaggtatttacaggcagtcaacttgcctactacattttatttgtaatcacacctggatgccatttacacatacttagtttagtttaagcatgtgcagatatgttacctcttcctccttgaaaggcttcctggttaccctatgtggctgtttgttcaccatctttgtatgggactttgaagctgaggacttggacagttcctagtgtgcaagtggtcagaagccctctccctccaaacccagtgacaatgtccctttagtaggattaaggtgccctgaggacctttgctttttaaattaggctgacacggagcttagcaactataagttcccccttatcctccctctatttatcattaatatgttgaacttctcagctggcgaaggataaaatagttgatagcaaatgaattagatatcaattaatttctaaagcaaacctaatgggcatttaagaagagaatttaatgtctcatttactctctatagctatcttgttaaatgccaattaagtatctaaatatttcctacaagcttaatgaattataataagtaaaaagtgattaccacttttttctaggatcttggcactctcgacttccagtgcaatgatactagactttttttctcatcctatttaggatacagataaaatagactaaaaccttcctaattaacattagctaccttatttagcaataaagtactaaatttatagtcaattctgaatataaaaaatatcagaatgcatgcagctagagaatatatgagtaataggatttttacttgaaaataaagtgagcactactaaagcattacctataatgaacgcctaatgtttcaccttctcaatgcctgcctcacctcaccccctcactgaaaccatttctagacaccaaggcagagagcatattagcagactcacacatgaattaatggggtgtgtgtttgtgattggcatggtacacaaaaacctaaaggcagcaggggccaggacagtggactccatcatacaaaatggggaaggttaaggaggcttggcctgggatctagcccttcaaggttttctctgccactctgggagaatagagtgatccttaggtttgcttatccaggctttgatatctaacagtgcactgtgggattggagagattagcagtcaatattcaggtggcaggcttaatgaactactgtttcactctaaggagggctctggtcctcagtgggagatgcagacggcaaagaagcagcccctgaaagtgagggtttgggtgggactgcagtggaaagaggtggagaatacctgccagacaggagtaacacagtgctcctgagcagtcagctctggtaacgtaactcagttacatcatgagttatgtatggatgtcattcagttcagaccatggagtggaggtcaagggtatgaaatttgggatcaaatagacctgagcttgaggcccaacatggctcatacttgtcctatgagcttgtttattttgaagattaaaagagagaatttgcttaaagcatgcaatacaatgcttaccaaatagcacacattcagtaagtgcacttattattagagtgaataataatggtaataaaaatattaaggatgatgaagtcactttgtttctgagagtgtatctgatttgtagactatccgtttgatagctcttccttccttaggaaagttagttaagtcatgattcagttccttcctaatgaaagttagttcagtacaacctgaagcatgtaaaatttccacgcagagtgttggtgtgcctgttccaatgatgtcgccactgcatgcaacattcatataatgacctcaagtgacaaaaaaaatccattatttttttcttccagagaatgaagggaacactaggtcattgttacatggcaacagctacttctcaaacaccttgttcaggaaataccttgttccaaatacatgctgcaaggctgagaaggactcttgcaactgggcacaggggtacaaacaccacctcatttcccaaggacagctccgctcttcaatgaggccattcatcctggccctacacaattactgtcgcttacacaaacagttatggagcattcaaatgacaaatgctaggcagccatccaagtcacatttctgaaaaatatttttattacaggaaaatgctcatgatgtagcattaaaaagggggaggaaagcaggaaaccaatcaaaagcagcagagaaaataactagtatagatccctgagttaaactcagcctcctttctctcacctccaggctggcctcaggaaaataccagacagaaatcaaaaggagacaaagatctaactaacttcatatgcatcaacaggcaatactggtctttactgtgatggttccttttggataccaaggcgggagttttgctaatcatgggaaaagttcctaaaattcccttctcaatagccttctcctaaagtccaaaccctccagtagctggccaaatttttgctctcctctctctctttttgcctccaaaatattctcattcctgagtttttttgttcatgctactatccattctctgtctaacctcctccatcttcctcacctctatttttttcttcttttggttatctctatgtgtaagtcaggacatgagaaaatgaacatttgagccacaaagcctgggtttgaagcctgcctctgaaattgcctagctggataatcttgggtgaatttcttaatctctctgtgcctcagttccaacctgtataatggggatgataacactaacacacagtctcttggggtgcttttcatgattaagtaagtgagtttatatgaattacctagaacattgtttggcttaagaactgaataaatgttcagcactatcatcatcatcatcatcatgtggattaattgaccttccctccagcttcttcaagctttttctccacccattataatggcttttctcccaaaaaaaaggggaggaaggatttgcaaataattcttacttaacatatatttaaaccctgtcatattattcaaaaaaatgcctgcatggaaatgaatctgtgttaagcagaataatggtcccccaaagatgtccatgtcttatatcaggaagctttgaatatgttaccttacatggcaaaagagtcttggcatagatggtgaatttaaggatctacagttggggaggttatcctgtggcccagtgtaatcacaggggtccttataagtgaaagagggaagtaggagattcagacaaggaaacagagatctagtgctgtcattgctgaaaggggccacaagccaagggatgtgggcagcctctagaagttggaaaaggccaagaacaggtcttcccctggagcctccagaaggaatgcaaccctgctaacaccttgactttagccacataagacccatttttagacttcttacctctagaaatataagataaattgctgtatggtaatttgttacagcagtaataagaaatcagtaaagtgtcaaaactatagctaaaaatattatgtatacaaagatagatttctgagaagttttccttttctttttatttgaactgtctctgtcttctaaaataagaaggcaaatgctaggctaagaaatgataaattacagatgcctgacacatgccaggactgttgttatgctgctatagaaagaacccaagcatgtggatttggagttactacaaatgcatggtcattacccatcactgagcttaaccatggttcctggctgttacaccaactccaccatccacttaagcagatggatggtggagacttctccatctgcttaagttctttttaccgatgcattgcaaactttactgtgtatataaagaatgtggggatcttgttaaaatgcagattctctcaatatcattagacatcgggaaaatgcaaactgaaatctcaaacaggtaccaccatataccactggaataactaagatgaaaatgactagcaagtcaccaataacaccaagtattattgagaatgtggttcaacttgacctcatgtatattactagtgggaatatagaatgtatttggaaaactgtttggcagtttcttaaatagttaaacatatatatagcatgagatccagccatcccactcccagatgtgtacccaaaagaaatgaaatatgtcctcacaaaaacccaattatgaatattcaggctgggcgcggtggctcatgcctgtaatcctagcactttgggtggccaaagagggcgcattatttgaggtcaggggttcgagaccagcctgaccaacatagtgaaaccccgtctctactaaaaatacaaaaattagccaggcatggtggtgggcacctgtagtcccagctactctggaggctgaggcaggagaatcactggaatccaggaggcggaagttacagtgagctgagattgcacaactgctctccagcctgggcaacagagcaagacttcatctcaaaaaataaaaaagaaaaaagaatatctgcagcagctttattcatagtagttaaaatctagaaacaatgcaaacagctataaactggtgaatgcagaaacagaaggtagcactcacacacagtgaaccattactcagcaacggaaaggagctactgacatacccaacaacacgggtgaatctcagaagcattattctgagtcaaagaagccagacccaaagacagcatactatatgattccatttatagaaaatgtaagctaatctctagtgacacaaaacaaattagtcatttcctggggctggggcagagggaaggagtgaatgtgaagaggagcgagggatctttgggagcgattgagcttttccgtgttttgatggccatggtggtttaatgggtatagatgactatcaaacttcatcagattttacactttaaatggatgtggtttattatatatagattattcctcagttaagtagataaagaaaaaataaagcagattctgatttatagctctgggctgggcaggcaagttaacatttctagcaattcctcagttgctgccgatgtactgggtcccaaaggctccagaatatcttctcttcaccttttgcacttgcaggagacacatttgtgtccaattttgctaagaaaatcaaggacttgggtaaggaaatcccttgaatgtcttttccctaccccctatgaatataaatccacttgtgcaacaatttgaatatatgcaagaaaaaatacttcaaaaggtacttctgctttaattgtagccttaccaatgccaccattcaccttttaatgatgaccttggcctgagctttaaattgaagcacgtgtgattagcaaccaaaaattgcattgggattatagtactttcactctaagtctttgagcaaatttctaggctttgcttaaaacatccattttcaggcatgattagaagacaattaaaatagaggggtaacagaaacaataaaattaatactttttgacccatgagggattagaaatagttcaagacaaaagcagaaaggatattggccacctcgtgcccttgcttagtgatattcatctgccattggacaaacctgggtttctctgtaagatgtaaggtatccatatgtaaaagaatcccttgacattggtacaaatccttcgcaaatcttcacatacttaaaaagcactctgtgaagaacaaagctttgttgagaagctgtttctaggcagtcttcaatgctgtctctctagtgacagaatttgtttcaattggagtccatgtgcaatccacgcccatgtctcaataaaataatcaattaaaataatttggggtctttagaataatggtaattgaaatgatgggtgctgtataaattccaaattccttgtgtactggccaaaacaaaataaaacgaacaaacagaaacactagagaaagcgatgggtatggctatggtagctataatgttttgtagattttattaactgtctatgctttcaatatctctaagataccattcaagcattgagaagggagctttaattgctgtctttccatctgcatttactcaaaacttacaccataaagaaatgttctgtctcaagtatcaatattgcatcaattgtgtttctgttcctctagctatttgcccctatggtgtcatttcatacattcatagaaacatggagaatttagaaattatggcccttctccagtacagttgagttttatctgtctatattacttggtgtttagcacattgtagctgttcaataaatgtttgatttcttacagaataatagtttgactttcaaagattttaaaaacaatctttttaatctggtgcaagcttggacaggaagactgctaaggcctagttagctcagaggcagaacaactgaaccaacctttctatgtgtgtcagacacaattttgttttcctgtttgaaaaggtaaaaacagagtcacctggctaaatggtttcctaaatgttccccctcctctgatcctcatgactttataaaacaagccaccacaaaacttctctaaagctaaactaacgtgaaataacccagggcttgaacttgtcgcatgacgttgctttaaattttaatacgagcttgggaatagatttgtgaacagcaaggtaaagcaaagcccatgaaatattgattctgtacattttcttatgcatttttattctccaatttagtaaatttttcatcttgcctgcacttaaaggttggctatgaagtcgttactaccaattgtattagctgttgtaaataaataattgtcgctaaagctgtttgcatgacgagaggtggacagggcctgctccttgtgagcactgactttccacagcccagcctagaaggatgaaagagatgaccacattttgcctaacagcacagtagcagacactttctaagggaaggagggttttaaataaagcaacaatgaagagctctaatgtttcagtagggactaaaccaccattctgacaatcatccattttggtcaaaaagaaggcagaattttttttttaattacaggacatcaggatagaatttcataacatgcatgcttcttggagataccctaatttcatggctctatgttagagaaattaaaagtgctagtctttcattactagccctcatccttgtatatgcataaaaagtcatattttatcagtcacgtgaaagacaactccattacatagttctcactgtcctcattctgtaatgtactcttcttccctagaataaacatgtatgcttctgtattcaacatatctaacaggaggtgagagccaaaagaaagatggaaaccaatacagacaacaaatggcacatcccttggtaaacaatgcatagaggatccagtgtggttctgccactgtggcaatcattctgattctttgtacagatttcatacattaactcattacttctctgttaagactgacttcagtttctctagaatcctggtcaaattgaccaaagaaaagacttcccctgagttccaaatttcttattccatgtgtccagaacataacaggaaaggagagaggataaaatcaggctaatatttagctttgaaatagctaaatatatctcctttttattttatcaggaattttgtcaccctgttaggcaaataataggatgcctcatttccagatttccccattttatatttattaaagttatatatgcttgcttattgtagaaagattttaaactgtaaaaacaatgtagatgagtttaactctgtttctgatgtctctacttgccaagaaagaagcaatatgggaggagaataaagacttccaataggttgttacctgcatttttggcaggtaaaattggcatacattttaagtgtttaaataattttaaatccatcactagtatgtttctctgcttacttttaattcctgaaacacttgatttatatgttatctaagaaagaaaaaaaacctacatagagtccaagtgggattttcccccctaagtttggtaagttttgtgtttgttcagtaagtctgtatacgggggttatgggacaatcttaaatttgttcattgaaaaccactgaatattgttgacttgagccatatattttgcacaaataagtcttcacctgcaaatacttgtacctcaagacagatatggcacaagaaaaagtatagcaagatgtatcaagtaaatacaactcccagatgcttggattaaacatcagtatgagcacagacatctttctcctcttaaactctccactccatccctagccaaatgtctattaaagaattaacaaaggtacagcataggcagagatgaccttagaacaagggaatggaccaatcaaattatggatggcttagagaaagttttggtagatatagtgcacaaggcaacaaacaggaatatagaaagagttcaacttaaaactctttcctcagaaaaggcattattaccctgaagaagatacaggggctcaggcacttatctggaggggtaagaattgggtacatgggtaggccatgtggtagatggtgacctcataatttgggcttcatttgaccttcaagaatcagcatcatttgtaacagcaagactttgagtgtccaggattagaaaggcagccacttgaagaagaaaggggcaaaaatggtgaggacctgtacaaaaagaaagaacttagagcttagcctgagggaaatcattaagtcttcccaatttggggtagaatgtgaggagagctcctgtggttgatgccctgattctgtgaccagcactaacaagatcagaagcgtctgaaaccagaggctttagggagacatagtattcaagttgctgttacatcaaagaaaaccctttcagggttacagaggcatttcctccatgtatcaagcaagagaaccaggaaggagcctgggcatagccaaagtttatattggagtacaggttgtgccaaataccaagtgaatacaaaacattgagctgagagcaatagcttcaccatgcatggaaagaattgctgcagagataaatattcctgtgaatgctactcagagcccagacttcctcccaactcccctctggctgctcaataacaatgagagtgttgtaaatttacaccaaagaagccctccagtttgagatctgagaagccaagaacaaccaaggggaaccagaaggggaaggaaagacaatttactcaaaatgtttatggaaaaacaccagctctgcttacatatctcatcacttaaagatgaacaactaaaacaacaccaacaccagctctatgaaaaatctcaaaatatgaaatattgagaaaatgcatgcaatatgcaaaagacataatacaaaaaagagacaatgtcaagaatgtcttcttgtgcctttaatactatttgagaaattaggggctctgtgaaaccagtgatgagaaatgggataaaaatatttaaacagaagagagataggcaaaccataggcagttttcaatagaaagctaaacaatataagggagaggaatgcaaggactgagttcagtacctattttaggaaccttaaaatgaagagaggatactgcaagagtcaaataagtgatgtggagtacaaatcaatcaggcttgcctggagtagagaggaaaaagtcaggtgatgagaaagaagacgctaggaatgggaaactagaacttagatagaagagacctaatttgtctctggaaaagatcccaaaagaaaaggaaggaagcagaaatcagagatataacagaagaaactttcctgagtaaaaaaactgattccatggaaacaccaccatgtgccatagagcattcatgaatacaaaggaacacctagatacatattgtcaatttctttttaatcttaaggaaaaagaaagaatatgtcaaacataaaaggaagagggggttgctaaacaggaagaatgggacatccatctaactcaagactccttttataccacaagagatgttaggaaaaaatgaagcaatgtctatggaactgagagtaagaagctggaatctaggaattctaaactcaggccagattctgttcatatataaaaacaagaataaaaacaaagagaagtaagagagagagagagaggtctttttcagatatgtaagggctccaaaacccaagcaagtcttatattttcttaaaagttgtagcaagtttgctttatacaggaattggttttggtggatgatgagagacaggaattcagaattcttttttctcatttggataaccacactattgctgacttggtcccatttatgacattttccatccttttcacaatgatttaataatttttaatgccccttatgctatatacaaagttcccttatatgtatgagactacagttatgctatccattttgtttcattaatcaattcattcatcactgtactaagactacattaaatattaataaagcattagaataaattctgatatttgataaacctaggcatccttcatttttttcttttcaatttcagtattttatttttgttggtcaataagaaaggatgttttagcctgctatttgtaaaacttctgcaaatttttttttaatttttaatttttatgggtacatgctaggtgtatgtatttatggggtatatgggatagatattttgatacaggcatacactttataataatcacataagagtaaataggatatccattctttttcttccaaattgtcgtggcaatttaagaattgatttatcaagactcataaaaactaagtttttggcttttgattggaattaacaattaaggtggagatgttttcatgatattgagtactcctgggacatattccatttgttcagttttttttttatgttctaataactgtttataattttctccatgaatattttccacatctttgttaggttcctactagatatctaattgttggttgtaattgtaaatgctgtagtttttctaacttattttctatttgattttgctgatatacaagaggagtattgaatttttggtttgtattaaacagatttggtgaattattttagtgataaatgtggtttatggatttttatgaattttctatatgtgcaactatattacctacaaataatgacacttttgactcttggtttccatttttccacctctcttgttttcatgctttgttgcattggttatggcctccagtggaattttgaagggtggggtgatttctgcactgactttgtgatttctgtttaacatgtttctttcttggatcctcgaatttagatttaaggcctggacaagttgtcttttttcccctaagtctctaacttcctgagctccagagttttcttatgaaaagagagagaaaagaaaaaagaagaaaggaagcaggagaaggagaagaagaagaaagggaagaggaaaggggaagggggaaggagaataggtgacaaagaaggggaggaggggccaggggatgggagggagagggggaagattctaaccaatgttctttttttttatttttttattttttattttttatttttttttattattatactttaagttttagggtacatgtgcacaatgtgccggttagttacatatgtatacatgtgccatgctggtgcgttgcacccactaactcgtcatctagcattaggtatatctcccaatgctatccctcacccctccccacaccccacaacagtccccagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacattagggttggttccaagtctttgctattgtgaatagtgctgcaataaacatacgtgtgcatgtgtctttatagcagcatgatttgtagtcctttgggtatatacccagtaatgggatggctgggtcaaatggtatttctagttctagatccctgaggaatcgccacactgacttccacaatggttgaactagtctacagtcccacaaacagtgtaaaagtgttcctatttctccaaatcctctccagtatctgttgtttcctgactttttaatgattgccattctaactggtgtgagatgatatctcattgtggttttgatttgcatttctctgatggccagtgatggtgagcattttttcatgtatttttggctgcataaatgtcttcttttgagaagtgtctgttcatgtccttcgcccactttttgatggggttgtttgttttttcttgtaaatttgttggagttcattgtagattctggatattagccctttgtcagatgagtaggttgtgaaaattttctctcattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctagaatccagcagaacatcaaaaagcttatccaccatgatcaagtgggcttcatccctgggatgcaaggctggttcaatatacgcaaatccataaatgtaatccagcacataaacagaaccaaagacaaaaacctcatgattatctcaatagatgcagaaaaggcctttgacaaaattcaacaactcttcatgctaaaaactctcaataaattaggtattgatgggatgtatctcaaaataataagagctatctatgacaaacccacagccaatatcatactgaatgggcaaaaactagaagcattccctttgaaagcgggcacaagactgggatgccctctctcaccactcctattcaacatagtgttgtaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagctaagtctcaggatacaagatcaatatacagaaatcacaagcattcttatacaccaataacagacaagcagagagccgaatcatgagtgaactcccattcacaattgcttcaaagagaataaaatacctaggaatccaccttacaagggatgtgaaggacctcttcaaggagaactacaaaccactgctcaatgaaataaaagtggatacaaacaaatggaagaacattccatgctcatgggtaggaagactcaatatcgtgaaaatggccatactgcccaaggtaatttatagattcaatgccatccccatcaagctaccaatcactttcttcacagaattggaaaaaactactttaaagttcatacggaactgaaaaagagcccgcatcaccaagtccatcctaagccaaaagaacaaagctggaggcatcacactacctgacttcaaactatactacaaggctacagtaaccaaaacagcatggtactggtaccaaagcagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaacataaaaaccctaaccaatgttctgataccactgcttctgttttcttccaacccattcttctcaaagcagccagcaaagaaaaataaaaaaaaatgtaaattagattatgtcacttctttttgcaatgtccaacaatgctaaaagacacacgcgcgcgcacacatacacacacacacaccacacacacaccccagaatgcctataaagatctgctcctgcctacctgcccagtctcatcccaagccacagtttcctttggtctctgtattccaggcaccctgcttccttcccattctcaaatgtgccaagctctttctcaccttattgctttcatgggcattattcacgctgtctggagcctactgccctccactgttccccttactagcttcacttccttcaagttttatatacaatgtcatttacctagtttaaattaggtcaccctgtaacattccagtgttttagaacaaacatctgtttttcaactgaagcaaattcccatagccaaaaccttttaaagtgagcaattcagcagcatttggtacattcacaatattatgcaacaatcacctctgtctactcccaaaacattttcatcaccccagaaggaaacattgcacccactaagcagttactccccactgctcactcccctcagcccagagcgatcaccactctgtgtctagtctctgtggatttacttattctagatattcatataaatggaattctataatgtgaccttttatgtcaggcttcttttgcctagcattatgtctttgaggttcatccatgatgtagtaacgtataagtacttcagtcctttacgaggctgaatagtatttccttgtgtgtgtgtgtgtgtgtgtgtgtgtgtgtgtgtatatatatgtatatatatatatacatatatatgtgtatatatgtgtgtatatatatatacataactcattttgtttatccattcatcaactgatggacacttggattgtttctgccttttggccattgtgaatagtgcagctataaacattcatgtacaaatacctttttgagtccctgttttcaaggcttttgggacaccatgctcttttaggttgttgcatgtatctatgcttctagtgtggtacctatgtgtatgattctttgtttagtgtctgcttgtccacactatttgctgaactccatagctgcaagggacacttgtttttttcaccattgtagcatctgacatgaagctgaaccataggagatatttgacaaatatgtgtgaatgaatgaatgagaaagcaagttgcccagattgacgaccaagctaaaggatgagacttggggataaacttttgaggtatctggaatgagataaggtgaggttttcatgtggttcaatagcagcctcttcctgtcactagaaagacttggtcactatcttcagtgaccaagcatcattatatctgacacattccaaactttgaaaaccccacatagtacaagtttagggaaaagagttttagtcatactttgcctgttccaccgaggccttagttggtgatgtccacagcaaaaactcagatttttgctcagaattccagctagggctctccagagaccacaactcccagggcagagctcattctgcatttccaagcttttctttctggatatcttcagcaaggcagaactggacaaaggtgaatgacattcaaggttaatcatgctggcgttcgtgattccagtgactgtatttgagtttgtttttcaattgttcttttgatggctattctacttctgcgtgccaacattctcagtttgtaatgccaactgtgctctgtagtgaacaagaacaagcctgctgcgtagtgtgagggtggcagcagcttgagcatttttatcgtctactcattgtctctgctgctgtgtctttcagtcctcctctgattctatcaatgagtctctctccctctacctttgctctgtctctgttttctgtctgtgtttcactctgctctgcttcatgtttctctgctcttcttcccgttctctctctgtcttcacctttccttgtccttctatgcctctcctaggggaggggatcatgtgctgcacaaaccatgtgtgtatattgttctgtctcttcaggctgttgttatccctgtcaataaacttcttcctgtctccaagtgactggtcctatctcctttacaatcaggggagaccggaactggctgcaatgaatgtgaggaagtctttataattaacaggatctctctgccatttacacaaacactttaaactacatagggagccaagcataccgtttgcacgtctgatgagaaggtaataaatgtgggggagtgagtggaaaaggggagggcagactgaggttaagtaacagggagagggtgctgggaggcatcagattaacacagggtggggtgggtatgggacgtttgtatttagctaggctccataattatgctctgacactttctaggtgccaggcactgagctaggctttaggaatagaaagctctaggggtagagactccaccttaggtgaatttagtttaagaagaggatgtattaacaagaagacacaatgtctgagtgcagtagagaagcagatggtgacttgtggatgctctcagaaggagagaaggagatgttagaggtgcagtgatgtttcagtggagccttgaaggaagaaaatgatttgggtagagagaagctgcagaaggcaagacattcttggctataggaaacatctgagccaatgctcagggttgggaagtcaaaggtatttgaggaagaatgagaatgtcctggttttaacagattggggttgggagaatggggagagaaatggataggcaggggctgtgatgtcagaagcaccaagtgtcccataggattctgggccattactccgtggggagctagacaatgtcatgaaactctatgacagcagtgtccaatagaacctcctgcatggcagaaatgcttctaacatggtaagctgcacagggatatcaagaattgagtccttgaaacgtggctgatatgacaggggagctgaatttttattttttttaaattctaatttattgaaatataaatgtaaatggcccagatggctgatagctgctatgtaagacaacacacccctgagatgtcatgaccagcatctctgagatgtcatgaccgtattgtcaggtaggcagtctggccacagtgtgacaaagggactggagggcctgatacttcagagagagcaatcgggacattcatggaaggaggggcaggtaaggacataaaccaggtgaggaccagggacactcaggattgagcaccttggctgggggatgtcatactggggagtaaagcccagggatgggcctctgggaggtgctggcccatgcaactggaggccagcagcaagctgccacagtgttcatacacccaagggtatacatcaggcctgggatccaggttgggaatatgataatgagattgtgaaggtctttgatggtaatttagctgtgaatcttggaatatctaaagcttgtctttgataagccatcccttccctgggatctctaagaatatattatgtggccgggaaacacagcaagccaaaaacacctcctggctcaaaggtcctaaaactcaaaggtgccatagggcctcctctgcttccttttcctaatgctgcatttcatcttctgatgaaaaatgaatttaatttaaagcaaagcaaatttaataaaaatccagacaggtattttttttttatttgttttggtggaacttgataaaattggtcctaaaatattcatgcaaaaattaaggctcagggatagctaagatacttgtgaagaaggagcaaaggagtcttgttctttcatacagcaagatttatttcaaagatatgataattgaagcagtgtaaatttggtccacagatagacaagtaaatcacagcaacaaactaggcagtgtaggaaaagctcttaaacacacatggaaacttataaaagatggcagtggcttgaacataggtgatgagagggatagttctagtcaataaatgttgtgggaagaacggtgatcctcaaagaaaaaaagaacatctgatccctgctttagaccatatgtaagcatcaaatctagaaggaataagcagtaaaataatagaacttttagaaggaaattaggataacatatttatgaccttggggtagataggtttttttaaaccataaacaaaaagcaaaaattataagggataagatggataaatttggctaatgagatagtctctcatataacaacacccatctgtacaaataactgccaaaaggttactatctggaatatataaagcactactataaatcaataatataaagacaaacatttcaccagaaaaagtgaactaaagattcatacaaacaagggaaaaaccgaatatggaaaccaaatagccaagctgtatataggaaaaagtgttcaaccatattaataagtcatagatacacaagttaaaatacaacagcattccccacccattttgtgatgctgatttttgctgaataggtggagaaaggcatactctcacatactgctggagtgactgtaagttggtgtgattcacttgaagatcaatgtagcaacaacaaatgaaattgaagatgtacacactttatgacctagcacttcaattgctgggtatttaccctcaataatctctcctacatgtgcacaaacacactcatggcagtgctacttgcgcataagggaaattggacacacattccatgacaaccagtgaggggtaaacacataaacggtggtatagttacataacaaaatactatatagaaaaataagttattgaatttagtttgaataaactgaatggaccaaatctacacatatcagcatggataattctcaaaacctgatagcttgaaacctttttttgaaaatacttcaatagtgtctgagactttttattcccctacatcagataatcctgttaagttattgtaattaaatcgatggtggttgcacaatttataggtccttcagatcgtaattttaataatgttatttttaacattattaaagaataataataataagtgacattcattaagaattggccaatagatagtatgttaaatgtatttcaggcattacctaatttaatcctataataatcccttggttattataatataattatagatgcgattattattcccaatttacagatgagaaaaatgaattaggaaaatggtattaaataacttgttcaaggtcatataaaaaataagtgatagaggaacaaatattcaaggtcaagataggggcgtaatataaaatctaatacaaggcttctgatattaagtccattggacaatgtgttcaccagagtattattttaatgagatttttctgataataaaaaataatttggaagtcacagataagcacaaaaaaatgtaaagaaaccataactctaccacttggacaatacattttaatatttatgtgtttgcttttaattttttaattttagcactatgtgcaagtagtggtagggaaaatttctaccccaagaaataacttaattattgacctattctgatctatttctggagtttttggaaaagtttgaactcttcatatgctggtcttgggagaatatgaaggcatgatggtaaacagaccttcactgaagttctagccatctccccggaagaagccacattgctgctgtcttcccaagttattaaaagtatggctgttaaacccaatgggttcccaatgaactccatcttatacttctcttagatagggggaggcttttaatacctttctcatcctccccctaccatcctcataccaacctaggggagtgaagttacccatcagggcataagtctcggtgtgtcccatacagcacataaatacaggacatctgctcagagatggggtcactgcatgataaaattccatgcatgcacctatgattctttcatttcttcttctacatggtcatattgttaggtgtattcacccgccttgtctagaaaacacttccaggcattatctagtggcaaatgatgccctgcaaggggacatttccaccaactgggtctgttcacaaatgtgccacaaattccacctacaactccaaaataggagtccaaaaatagttgaaacattggcagcctcactgagaaggagagtggcttcccgcaggggccgcttctgagaagacaacttcattttgacagatttgtgctggtgtgtctgttaacaacatagtcttctcacttttcaagcttctccaggatttcccagggcttggagagatgtttgcacaaactagcttcccgagataaatcccaagtcacgtagccagggcttggcatcaaattgaaagacagtgcaaaggaaattaattaaaatctggccggagggatccaacagaagcagacatttcaagtggaatcaatacaaatgtaagcgccacaaaggctgtgactttttgcctattttattcacggctaaatctccaaagctagaaacattcctggcacacagaatgtgattaataaatatttgaatgaatgagctagattcagttcattctgcatttgttgaactgctactgtgtgaggatttgggagctggatttacaaaggtcccagactggtggaggaaagaaatttaaaacaaaaaacaacaacaaataactatataggatatgttaaatactgtgataaaatgtgtaaagtctctgggggaaacgtgaccaagatataattaattgtactggcaaaggatggagtagctgcagaatgaaggtaacattctaggacttggtagtgttagcaggtagtaggagcaaaagggctttccaggtggaaagaggatcacagacaaaaatatggaggtgtgaaaatgagtggtgtatttagggatcacctcatggagttaaaaaagcagctaccaagagcaagggcaaggggggccctccctcaacagcatgcagagacaccgtttgttttgttttgttttgtttttaagagcatctaccaacttccaggcactgtgcatgtttagtagtagagacacaaagcaaacagcatagatgtgcccttggccacaaactatttacaatctgataatctgcagtgagacatgcatggccaaggctgctatcttattcttctttgtatttctgaggtttcaaatggatttggcacaaagcaaatactcagtaaatgttggatgaacaaatgaacaattcagagcagtttgctaaattggaatgacaaataaaaatgagaggcaggcttaggctatactttaatgcaaagcaaaaaagcagagaaagaaagagaagtagcatgagtttgaagttaactagctcaggttcaaattctggtcctactaagtgtagatgacctataagaaaatacttgaaatctgtgagcctcagtttcctcatctgtacctggatcatcaaggccagaacagccagacacataggcaaagctctacctaatctgttattaggggcacacactctgcagagaggttttagcactctgaggcactcagtgcttaagaacatctttggagatagacaaactcagtttgaagtaaagctcaaccactgtcagactgcacaacatcaggaaagctatttaagttccttgcagctcagtcttctcatctgtgaaatgggaataataatagtatctacctcacagggctttgaggaggattagaaaatataaagttggtgcctagtacaaaccaaactttctaactaaatggagcttaaattacagttgattctaggtgggcttgatatttgatattttgaccactaaatggtaatacccctacaacaaaattctaggtgggcttgatatttgatattttgaccactaaatggtaatacccctacaacaaagtaagctacacaaacattgtgttttgtattgttatgtatcaagctatagcaacttagcatcttagaacaatagacaaatattatcttacagttctgtgagtccagagtctgggctgagttcagctgggtccaggttgcaatcaaggtcagtcagggctgagatttcatctgaggctggactggagaagaatccatttatgtagttgttggcagaattcggtttcttgctggctgttggccaacagctgcccttagtttctcagcttctggctttctccatagggcagctcacatggatgagaatctctaagcaagatgggcctgacaatcctatgtatcaagtcatgagagtgacatcccactaaccttgcagtattctgtgggttaaaagcaagtcacaggtcccgtccacaccaaggggaagggatggcacagggcgtgaatgccaggaggtgaggttcattaggagtcaccttagtctgcccacaacaagtgcagagtgtctttctctcttgttcctcactggattatcagcccctagaacagtgcctgccgcatggcgtgtcctcagtaagtaaatgtattggataaaagaatgggaagatcataaatgtggtttctatagtggtgtgtgtgtgtgtgtgtgtgtttggggaaaaagaaaggagtggatgactgctacattctgaattaagctgagagcagaggtgatgaagaaaatgtccaggcaactaaggagtggtgttgaagttgcccactcctacctttggctgatatgagtagccacactgaacagactgagacagagccaaattgcaactcctacctttccctgggacctctggggtgttcagtagcatacaccaaaaggaaaataagatcctcattgtggacaagtgctcacaacctttaccatgatcaactgtcactctccttccttggggtatgatcagcagctaatgctaccctacagcacatcattcgaccttctcctgatacacaaggcaaatactttcattaacaaaattaaaaaagagtaaatgaaaatatctcaaactaaaggaagagaaaaaatataataaaaataaaaggaagtcacctgaattaggttttcagaccctcaaaggaaacctttgttgtgaggaaagactcagcctctaggactggatctcgggcaggtcagggggaagatggagctcggagccagaatccctgtgggtttggttgtgggctcctgggctcctgctccatactcatgttaactgtgtctgaggacagagtgggttgccatataagctggtaggaggcctgtaaagagaggcagcatttaagtttatggacaaataaactttatcatgaaatgaacatgtgcctgaaggtggcaaaagctctgcttttctttctgttggctgggatttgagggaagggctttgcggatgaatggatttaggaggcagccagatccacatagccccgaagaggtgcagatactgcccaaactgcacctctctgcgctctgagtgcacccaaagcccagacaatggcaggcagggccgaccagctccttacaccacacacatgtttcaaaggaccttgggagcaggttttcatgggaggggcaacagcaatgcttggatggaagaagccgattgaaatcaatgagaattgatttagagtgtgggggccaccgtgttaaaatctcctccctcttgatagcgcttcatgaatattaacaaggttaagatcaataatgagctgattttcagatgcaaacctgacttcatctgcagattaaaggaacggaatgatggtgtttcttcttgcactgctcccacccatatcttagtggatctaagaccccaaaacccaaatgaaacctgcaaggtgcaggtcacttcatgcattgtcacataaaagtttgttgtacatctgttctctctgtgcttagattggaggatgttggatgttctgtgttcaaagcctgtatacaaatgcatgtgtgtgtttacatgcattcattcatttattcataaattttgtttccatcagttttcttcaaccctattcttgatctttgtcatatctcagcttttcccatggactcgtaattggtttcctggatttcagtattgttctttttcaaatcaccctacaaaactctataaaaatggtttatctgaagatctgattcaaacaagtctttcttcggctgaaaaatctgtccaatgttccccattgcctgcaggatgatgtcctaactccctagtagagacatgtcaaaactggggtttagcctcaaactgcatgtacactcccacaatgtgtgaaatgtctgcatttcagctggggcctaaaggatgagaatagactagttccaagaagacacagaggaagaacattctggacggacattacagaaaatttaaaggcccaagatagaaaagatcacagtattttagagaacagaaagggaccaagggtatgtgtgtgtgtatgcgtgtgtatgtgcgtgtatgcatgtgtgtatgtgtgtgcatgtgtgtgtgtatgtatacgtatgcatgcacatgtgtgtatatgtgtttgtgtgtgtgcacacgtgtgtgtgggtgggtgggaactgatcatttagttataaatcacccttcaccctttcctatttggctgttgcctgaacactcttccaggatagactgggttaggaaagaagattctaggcatttcgtgggaggtattaatcagtgtaataattgtggtgcatgttgcatactgggattagatatttttaatagcataactaggttccctcagtgtagagggaacctgggcagaagctaggagcccaccttagctcacggggagtggcagcaagaattctgagagtgactttcctccctggtgtagactctcagacttcactcttaaacctgcgctaagacttggctgagggttcactgacttcctctgtcctgttagagagcctaggaccagtgctcctccccgtatttttgaggagtcaccttctctggtgcctttgagtgaggtcagacacttctcggaacaccacttatcgagaatttcccctgccctgagtgcagacagggtcatgcccatttagctgtttccattaccgcctggcccttcctatcttccactgagatttattaggacctcagaggctgagccatgacctgggcctgatgctttagatacacacagtacatttacgccactccaagttctttcccctctgctgtcgtttttggttccctcaaagttcaaaagtgtggcaggatgtgtcctaccaacccccttttgcagatgttgaaaccaaggcctaggcatcctaaatgatgcccccagtcccacccactgtgaatggaaggtggaagtatgctggattcttctgcctaattaacccacctgtttcctttctttgtgcctctacatggtcccagaattggaaaagtttatggatcatggaaaattggttttcatgtaaatccgtgttccataactcagactggacctaactctcccctgcagttttacagtgggttggcccatactcccattcttcccaagggctacttcaaatcttttttactttcccaaaaccatgcatcctgcttcttgccccttactgtcagcaaatgacctcagctccctacttgcaaatggaagctcccctcaccattcagttagagaacaagccaacaggtctgccgatgccacccctcccctgccttcctgccttccacagcagggcagctgccgcacctgagcttcaggtcccagcccttcccaccctgagacctttcaccttttcattccttgtctttcttgtaaattcaatctccacctctaaccagaaaattctctattgaattctaaaaatgctcaagtctctcctattaaaaacaagaaaacaacaacaaaagtcccacctcattagacctcttcctctctcagcttctgtcctacctctaccacttccatcatagtcacgtttctctagagggttgtatgtgcttactggctccatttttttttcacctcccatccacttctcagttcacactaatctggtttctgttctcatcactcactgaaaaagtcacgatgaccttccaagtcgctaaatccaatagacctttatctgtcattgtcttccttgaacccttcatggcattcaattccagagcacgctccctctctctttcttgaaatactcttccactggcttctgtggcagcacattcccttggtttttctatctctctggaagctttctctccgtctccttttcatgagtctcctgaatactgccattaaatgtcatagttgctcaaggctcagcttgagactctttcccttcttaggtgaactcatctcatatgaccttaatttccgactatcaggaagatagaaatatatttatttgaggaaaaaaaagaatgatacatgttctctatatacgaaactgcccagttgacattctcttttgaatgtcttaagggcaccaaatactcaacttctagaaaaataatgtcaccatcttttgcctcagcttcaaatctggttcccttacagaatccccttctcacactggttgccatcctccagccaggagtgcaggccagaaacccaggaagtcattttcaacacctttattccttaccccatccaattcattacccagtcctgtaatatacattttaagtattttgctaactatatcccttactactattttggacctagaaagcatactgaactgaaagagcagacctggcacaaccagtgacaatctatatgatcctgagctaagctaggcacgtggtgcagagaccagtgagggctattgtgaatagaagctcctgcaggtgaacagggccaagcaggagattatgaaatctcaataatttccaataattctttaaccctaatgatggacttagtttcctaatgtagtttaagggctttaaagctaaactgtccagtccagatttctgcaagtaaaactcagaaatgggtaacactggtccttattggaggctattaagagaaggaaagcagctgccttcgacagaaacatattgacagaaggagtgggagtgtggacctgtaagaggtttccaggcatggtttacaaagtctatccaaaggtcttgtttcacctcaagttcatcaatgcttgcagggtatctttctgtggctgtaaatactcctctgaatcttgctcattcctaacctggagttctaaattcaaagcagttaacccttcaggaggatctgagatttacatgcaaggagatttactggtgagtgctcacaggaatatcagcacagaagacagcagcaggattgggcagatggaggagctgaacggtgctgtcattgcaagagcacttcagccaaacacacagggatgctgtgatgaaccccagagacttcctgaattggagcaagggaccaagcctttgtacctgctgctttggctattaatggaggttaataaaggttgactctggggaaggggcttagtgttgagttgggcaggttcctttagtcaatggcaatttccacagaaggatgaaggtatgtgagcagtcgggagcctcacacctggaagctgggtgaaggactgccttggtccttgtcctgaagaaggatctgagtgctgcagcacagcatccactgtactcacttggccaggtgtatcatgatctgctgctgttccctaccctgtctttccttctttccttctcctctcttatgaggtgattcataaggaggctccagaccttgcttttgccttttttttccaattagaattgcttcccttcccaacctgtagcttcctcttcttcttcactctcttatcttacacccttaaccaaactccagatccaacctgaacacacctggcacatcactcatggactcccacacttctctctcactttcttcctttccatgcccctctaactgtctctatctctctatctatcatatctatctatctatctatctatcatatctatcatatttatctatcatatctatcaatcgtcttctctatctatgtatctatctatctctgtcacatctatccatcatctatctgtctatctgatctatcatatctatcatctctattatctctatctatcatccatctgtcatatctatcctatctatttatcatctatctatctatctatctatctatctatctatctatctatctatctatctatctatccatccattatctctatctatctatctatcatcatatctatctatctatctatctatctatctatctatctatctatctatcatctatcaatctaggtatctatcatctatcctctctctctctctctgtaaatatatctaacttcaagcctatctcaggccactttattaaaatatcagtgttgtagctgagatctgagtgaagatcctactgtcttcactcagctgtggtggtattcctaagagcagtcaccaaataaaccttgcatgtaaatatcatggtatatgtaattgtcattattcttttaaatttagtttaatcacacagctgataggctttcagtttaaaactcttcaaatgatacacagcaaaattcaccacttaatatcccctccacttcttgccccagaagtgattcacttatcaattttttcatacataaatatatataaaaatgcatatagatgtgtggtttacttctgtattacattggacatatgccttgctacattctttactcacttaacaatatattgacaatgtatgttggggctgactagtaccagcttgtgagagccgactgtgtggatctcttcccaactccactttcagtatcatcacatgggtagcctgtgattggccatggtgggagtatttacaccacagaaggcagaaggcagcaaaccctgccaaccagtgtctgtcctggagagccggttgttaaacatatactagttcactgctgattgtagaatcgtttaatgtccatttgtatacatttattttgtcttaattcttgcaaaatttttaacattatgaataaatacagtttagccagtccctgaatgaacggttttcagattatacccacattttcacttgcacacacaatgcttcactgaatgatattttcatttttggacaagtctgtatttttctcgtaaagttacttagcagttgtactcttgggttgaagcaaatatgggttttatatcataatagacaaggctaacctgtctttcaaaatagccactaatttacaccttatcgatagtatgtatcagtaccattgtgatacttttgtgatactgccagtctttttaataattgcacatagccaatcttccaacttgtagattccttaggcagataaagggaaaactgctattgtactgaagtattgctattagtaaaaatatcatgataatggcgataacaaagatgataatggtaaaatagttttaaaagtagtcatgcataattatgttttcaaatatggctgctaattgcgcaaaaaaactgatattctaagtttttatcttctttttgcaggagatgtggctcctaaaatcatggaaaaaattaacttggagtttaggcttgtgccactaccctgagtgattcaaactattattgtgcggtatataattttttgaccaaaaaatgttaactataactttttacacagggcatttaatttaatcacggcgacctgaaatcatagtctttccctgtaatggttttaaagtaccattccagccactcaggatgaagtgctcaggaataattcaggtgcctcatctaatgccctcacttatagacctccggcagaaaatggggattctgcagtttgtttttactggctgtattgatctgatctgaagaatttcttcctccacagctaaatcagtaaattccacacttagctggcattttgctccagtacttatacggagagttgaatttggagtcatgaaacaatatattgtcactgttactgatcctggcgcattgctattaaggggagtctataaaattcttgcctgtgtgtggaaaatcactattgccaaacatcagggatgagataagcctcttgaaaataagatatgcctgcttatattccattgtatatctctctagtagcctttggtgtgaatcatgttatttgagggcatatttggctttttcaaattgttaatgctcgtggaatctttcttcagagatcaagttttaggctttttgcttccttttcaaaatcaggggctactaatgttaaatggactttatatcataagagctaaacatgattgagctcttcctgtgtgccctagtgtgtggtaggcactttttcatcattatccaatttagtcttcacaactaccttgtggagtagatattattattactcccattttacagatgatgccactggagcttagtggattaataaaatcacacagctagtaaatgatagagctcagagagtcaaattcagggctcttttctttagaaacccagccctttcctgaggtgatatcctcgaattaaattctttttttggggagggccctgattggtcaacacatcctttgatgggcagccagctgggcagtgatcaagagtggaagcaagaggccagagccttaagttggtagaccacaagcccgggaatgtgtttcctcttcctttgtatttcagttaggagactgtaaggctggcccactcctcatcccttccaagactccacaaaaactagctcactgatcatgtctgatttttcaccttaggtaggcaaaaataaatttttagagaggaaaaagaaaaaaaaatacacacacacacacacacacacacacacacacacacacatccccaataagcattaaaaaatagcatctcagggaacaaaggatatgcttgattctacaggcattccagcttaaaggaggtcttgttctgttaaagcttgcagaaaacaaaagggctgcagctttcctggatttgatgtttctctctagaggagcagtgccattcaaactaatcaaagttttactgggttcagaaatgccaaaccagcacattttgtattcctattcccccaaaaacactgtctgcaagtgaaaaacatctgcatctaaaacaagacaattaacaagaagacacgcgcgaggctgatgctaatgctgcggtctatttttggttgccagctaagtgaggtgcagaagcagagaaggagagcgtgcctccctctttttttatttttttcatttttattttttaaactgcggtcaaatgtacataacataagatttaccatttgcaccatcttttaaatgtacagttcagtggcattaagcacattgacattgttgtgcaaccgtcaccaccatctgtctccagaactttttaatcctcccaaaccgaaactccatactcatgaagcattaactaactcccaactcctccctaccccccaactcccagcaaccacccttccactttctgtctctgaatttggctactttaggtatttcctctaagaatcatacaatgtttgtcctcttctggctggcttatttcacttagcataatgtcctcaaagttcaaccatgttgtagcacgtgtccgaattttgttcttttaaaggctgaatgatattccatcctatatatgtaccacattttatttatccattcattcgtccatgggcacgtgggttccatccaccttttcactattctgaataacgctgctatgaacttaattgtacaaatatccattgtgtcccattgtttccctgctttcagttcttttgatgtcaagaagtggaattgctggatcatagagtaattctgtgtttaattttttttttaggaccggccacaccagtgagtgagtctcttaacctttcttaagcctctctctggctaagctcaactcccttggggagactctaggggatgccacctgggagggcattgtggtggagggggtgacactccaaggagtcttcttggggaaggagctgagtgagaggtggtcctcatgcacctcatgcagaagatacctttagggaaagagaatggctatccctggagacagggattgagcagcaactgaattcatagacaatttttggaagcctgataaatgccaatgctaaagatgtcaaacaggaagaaaaaaattttgtttaaaacaaaggttattgcattatatttaaggacagatgctgcttttattttaggaaactcaaggatgatggctgtaataggagtatgtttattttagttaggttccctgggcaaagcctacatgggtggggataattttttatatttctacaggtcaacgaggagaaaagagttaatgagggcaggaagagggaaaagaggagatgtgagaaagattgagcaagtggagaaagcccaagaagaggccaggaggtgagagtctcaggagagaaagtgggccattgagaagtccctgagtcaggggtagctaaggaatgctgctgggtcagtaagaaccaacctttgacgtattgtttcctgcaactatatcatctccttgctttcactgtaaaccttaagtgaatgcttgctaccgcaaatgagcatcgtgttactaacattatcaggatttcatgaaggaaggggttggtgtttggcttaggtgagcttcccccagaaggagatgctgtaacatgcgtttcagtgaagtagatcatctgggatttggggagcacctataagggagcatagaagtgagataaagggaagaaaacgattcaatatgagttcatgaacaggttacctctgtgaacaactagggctcagtctccctggaactctctgcaaggctgtgtagaacaagactcagaattatccctggggcaggaaacggagggcgataactacttaaagtctaggtctcattgctttttagaatgagggcaattactgatgctctgatgggtgccttggagcaactttgtgagcaaatgtgcaaagagtaaatgttgctggggcctaaagatgagcaaggtgaatgcatccttttcctgtataccccactggcagacaatcatgggctgagctttcctgtttgtctccctaagccagctcccacctctgatctttcaaccattggacagaaacatagcaacaggaaggaggaatatagcaataagaatttgttctaattcttctctctcaagaagtattttccataagatagaacgctattgacatttttagacttttatttattggattaatctctgatttatcattcagtgtacttttctgtctgctatggaaatgatgaatgatgtcataattataattttaaacacttcaaaaaacatctcaaaaaatccacctttcctctccatcgcaaacaacattctagtttttgtacattccttttagctctagcactgtggataaattttacataatattaattatggcctgcaaggaattttatattctgctttcatcaattatcttttatcatttagatttaatttatattttcttcagtctttatagataatgtttgaatagcaacaaagtatttcatccagcggctggacaataatacatttcactagtcccccatttctagaaatggatgattatcccagattgggttccaaaggaagtgggctccaaaacagacacttgcagggagatctattacagcgtgctcttgaggatcaatacctgtggaagtcaggtacagacagcacagggcaagagggaagttgatctctcatgcagttattatgaaggtgttagctcagcccaggaagagctttgaagcagggagggtcttgcgaaattgtgtcaagtttgggcaagcagacagggccttaacaccatcacattgattagtcactggatatgggctataacctcaggcaaggcagttttcttcaggccaggaaatttccaaagaggtagatagctgagggctgtcttacaggtccctcagagcaatgtgggtagtgcatcagtgcccagcccaagggcattttccagtttttctaattaaatatcacagcgatgagcaactttggacagaatgtattttccactacttctttctggagattctggacaaaattcaaaagttgaaacttatgtgtttccagctctgggaattttgcctctaaaatattttctgacactgacacagttgctcaagctcttttgtttccctgatttctaaaatggtgacaccaactccagctaattaaaaatatagtgggaagaaaagtaacatcatatgtgtgaggcattttgaatattacaaatgtttttctcaaacttacattggataatggttgtaaaatacagattctcaggttcattccctagatattccaactgacaacatttcagggggcctagaaacctgtattatgaaacaatataccacacaattcttatccctgggaaaactgagaattgctgctttagaatataaaacttgatgaatccagcatatttgggtattactctgctgctcttttagaaggaaaacaatttgcatcctgtctcctttgcctgcacccttcatcaagtccactctagtttcagcacactcttttgttatcctgtcacttaaccatcttcttgaaataattacagtccaaactacaaatgtattttcacatgagctcttaagtaaacatcccccacttatgactccctgctggacattcactgagacccgaaattgtggaggccactgtgtcaggcattttctatacatgatgccatttaattcttttagcaacacctaaggtagattttatcatctctacttttccatgggaagaaaaggactgttttggaggttgaagagagtgtccaaaggctcgatgagctattaactcctccaaggtgttaggtttggcagtcactcttaaaagttgtaaagccaaactctcaaacattcctcataaactcatgggtatctgtaacagaagactttttcagttgtaagtcacacaaaacccaatccaaactggcttaagcaaaaagggaatttattggctcatgtaactaaaaactctatgagtaactggccttcagatgtggctctttgcagggggtcaaatgatgtcatcaagattttttttttgcctctcgacttgagtaactgtgtcttctccattgtttccattcccagagagactcacctcctcttgtaaagtggctgctatcaactccttccagctttatctccaatggaaaagagtcttaggcagtcatagtcacaaggtctggagaatttccatgattggagatacttcagacatgtacctaatattaactgttgcctggaaaaaagacaacttgggtcatgtgctcactccctgttcctccaaaaacttgaaaactgagtggtggaggggcaaatctccaaactaaaatttgggctgttacacaaaaaacaaagaatagatgctgaggagccaataggtaaatttctactgctatatcatcagctttttcttcactttccttttgtattgagtcttgttaaatatcctctaacagcctgcctagagaattcaagaactgttccaaagacttcatacactaacttagcaatgacttattagacacgtactgttattgtctctatacctacacacagatgaggaggcaggagcctttgttaaaggtgaaattggaacacaggccaactggctcccagatccattctttttcccaccaccgtctatggcctttaaaaatcatacgtcttcgttgtctagagtcagtgtaatgccatgggcttcacatgatctctttctgaaccactcctagatagcatccagcctcaggtctcttcccctccatctatctaacctacacatcttcctagagaatcacacccacgctctctcacccacacatcatctgtagacaccagccacatgcctcgctctactctagatacttgggagtgggaatgaggagtatgtgttcaagaagacagtcttgattcttgctcaggcagagaccatggaaaattaaacagggaattatgaaataattcacatgccttcatattttacctagggacaaagcatcaaatgaataaacacacatagttatgtactttgagtgtccttctgtcagtgttattcatatactttaagatgagctggctgagggattaagaggcagcttttatttctggtagcttatagatacaagttctcagctgcaaagttctggcttgggccccttgtgagttcttggactgcatgaaacttaaagcatgatggtttttcccagtggtcccccagatgtgctagagcatctctaaggtatatatgttaggtcttttcctaggggatcccactatggttatgagagtgaaaatatgtacagtatgtcacaaacaccagctgttaccttgcaataatggcatttctctctggagctgatcctggaagcagagaagtaacataaatcacactgggaagagccttggactaggagtcaggaggtcagcattacagctctcctattgccctatgtctgggtggtctctataaaagtctcttctcttaaaaaccacatgattacctcaataggtgcagaaaaggcctttgataaaattcaacatccttcatgtaaaaattctcagtaaactaggtactgatggaccatatctcaaaatagtaacagctatttatgacaagcccacagccaatatcatatcgaatgggcaaaagctggaagcattccctttgaaaaccggtacaagacaaggatgctccctcttgccactcctattcaacatagtattggaagttctggctaagataatcaggcaagagaaagaaataaagggtattcaaataggaagagaggaagtcaagttgtctctgtttgcagatgacgtgattttatatttagaaaccccatcatctcagcccaaaactccttgaactgataagcaacttcagcaaagtctcgggatacaaaatcagtgtgcaaaaatcacaaacattcctttacaccaacaatagaaaagcagagagccaaatcatgaatgaactcccattcacaattgctacaaaaagaataaaatacctagcaatacaacaaacaagggatgtgaaggacctcttcaaggagaactacaaaccactgctcaaggaaataagagagggcataggaacaaatggaaaacattccatcctcataaataggaagaaacaatatcgtgaaaatgaccatactgcccaaagtaatttatagatccaatgcaattcccatcaactacctttgacattctcaacagaattagaaaaaacaattttaaatttcgtatggaaccaaagaagatcccgtatagccaagataatcctaagcaaaaagaacaaagctggaggcatcatactacctcacttcaaactatactacaaggctacagtaaccaaaacagcatggtactagtaccaaaacagacatatagagcaatggagcagaagagagacctcagaaataacaccacacgtctacaaccatctgatcttcgacaaacctgacaaaacacgcaatggggaaaggatctcctattcagtaaatggtgctgggaaaactggcttgccatatggagaaaacaaactggatcccttccttacaccttatacaaaaattaactcaagatggattaaagccttaaatgtaaaacccaaaatcataaaaaccctagaagaaaacctgggcaatatcatcgaggacataggcatgagcaaggacttcatgacaaaaatgacaaaagaaattgcaacaaaagccaaaattgacaaatgggatctaattaaactaaagagcttctgcacagcaaaagaaactatcatcagagtgagtaggcatcctacagaatgggagaaagtttttgcaatctgcccatctgacaaaggtctaatacccagaatctgcaaggaacttaaacttatttataagaaaaaaacaaaaaaccccatcaaaaattgggcaaaggatatgaacagacacttctcaaaagacaacatttatgtggccaacaaatatatgaaaaaagttcaacatcactgatcatcagagaaatgcaaatcaaaaccacaatgagatacccatctcacaccagtcagaatggcgattattacaaagtcaggaaacaacagatgctggcaaggctgtggagaaacagtaacacttttacgctgttggtgggaatgtaaattagttcaaccattgtagaagacagtagggcaattcctcaataacctagaaccagaaataccatttgacccagcaatcccattactgggcatatacccaaaagaatatatatcattcttctataatgacacatgcacacatatgtttattgcaatgctatttacaatagcaaagacatggaaacaaaccaaatgctcatcaatgatagactggataaagaaaatgtggtacgtatacaccatggaatactatgcagccataaaaaggaatgagatcatgtcctttgcagggacatggataaagctggaaaccatcatcctcagcaaactaaaacaggaacagaaaaccaaacaccgcatgttctcactcataagtgggggctgaacattgagaactcatgggcacagagaggggaacaacacacaccagggcctgttgtggggaagggggttggaagagggaacttagaggacaggtcagtaggtgcagcaaaccaccatggtacgtgtatatctttgtaacaaacctgcacattctgcacatgtatcccatttttttagaagaaataaagaaaaaaattcttcaattaaaaaaatctgtgattaatatgaaaaaaaactcttgtcttttctacatctcaggcctcccttttgcagagtgaagggattgaaatagataaacatgaagtgatattacccactgtgccaagattggaggacaaagaggcactggagaacattttctaggttcttagacaagttgtattctgatcagggcgtggaaagttatgacagaattttgttaggaatgtgcatagaaagacatcaggacaggtgccaaatctaggaaccaggtgttcagaacagactcaactatccatgtctcaggactgatcagggatgagaggacattagagagaccatatgatggcatcgaagtgtggccagaagccatatgcgtcttcatgagcctgcatctcagggttaattcttccaagtcctgcccttagtctgcttcctactaaggactcttcctcctcctttctctttcttggaatagtcccaggactttattgtctcacgagacagagactttgccttcttcatagctttgccacaggcagttgatcaaattgcatggatggggaattctggtccttattagaaaaacagagaacttctcccagatgtgacaaatgttacacacacttgctctcattccttctccctgtgtctataaaaacatcactaaccaattactgcttctttccccttgggcttgggcatagctttagggtcttcagcacagtcttccaaacagctagtaccaatccactaaagatggcacttaagatgaaactgattgctcaaactagcctccaggttgtctcatcgatagttcttttgagaatataaccttagtatcctcccatggtaagtggcaacgtggtttgaagcttaattttcagataaataatgaaataataggagctgtaaagacagatagagatagacagaaaagttttaggtacactgcctacagaagagttgggtaactgagcctatttaaggctggaactctgggtcatagactgtgagcataggcagctgagcagatgtggccagggggttccccatttgtatctgtctgggcttagtacaaatggacttccacatgtctcctagagtgtctggtgtctcctagagtatcgtttcaacttgttggctttcattcagattggattttaggtacagacaggatcgtgtctacccatcctatcattattatattctaccagtctattaagaattgataagtaatgggctggtcctgtttccagcccacttcaatcatgtcttagtaatgggggtttccaaggaaagaattacaattgagtaagcacgtgacctccacattcatatttaatcagatgccagaggaccttgggcagatctcaggttgccaggggttctacaagaaactgtagggtcttgactcttaaagggacaagtttcgtcctttgttggaaatacaataataacaataaatgcaagaaaagaagatacagaagataagacattggcctgatgttttagtagagatctggcttaaggtgaaagcagtacagactgaaaactttggtgtgaagttaatcctttagtttcatgtatctttgaaataacatggaaaatgtgagcctcaacagagaaccctgagttgtcaccatggctgtattttagagtggactattaattttcctaattagagacagtgcagtgcagtagaaaaagatgtagggtctgacatacctggattttaaacttaactccatcccttacaatctatcaacttggaacatgaacttactcctcctaaccttcagttttctatctacagaaaatggagcaaattgtaattgtttgtactgtttaaatggcatttctctaggaagatggaagaaccacagtattatatatgagcgtatagagatctgtccataggcatcaggcacttttaggtcacctgtctttagccctgttagaacagcatcttagaccagcaaaatcccagacactgttcccacctgggagtctcacttattcccccttgtgaagggtaattgtgcttgtacagccggttcagcctttttctatttagccagcactcaagtctcaccagtgattctcaggaggccagcaatgaatattgtttaaatagaaaatgttgtttgtgcatgcagtgtcaatgaagatgttattaatacagctccaggaaagcagctgctgccaaccggctggagaagccacagccccatacagagcctgtcccacaatttcagggctgagaggcacttaaaaggcatcaggtctaacctctgtcctatgaccatctgacctagataggctccagcagttccaagggaaggacacctaccaaccatcttaacccataatgtggtttttccatctctggataaatctgttcattacaacttttgtgtttgttttccagcattggcctcaaatttgctttttaagaatattctctcattgatgataattcagatccttgtgactacacggtacaaataaaatatcccttccttgtgacagttgtggcttcagggaggtgtctctacttgcaggttaagccttcccagttttcccaaggatccttcagatatcgtggctactgacctctattgcgtcagacccatgtcccagctccaccttggactagctggctgtgcagtcttaggcaagcatccttatctcacccaaaccccagtttcctcatgtgtgaagcaagaaacacgcatgggtatacatttacttaaaatagtatggggcttgagggatgtgaaatttaaatgagaacagttataatatgcttgacacagtgcctggcacatagtaggcactcagtaattatgagtgatcattattgttgttttatcattcagcttggagcacagtaccctaggtgcgctctaattaacccataattgatcagaacaattaggtttcatcagagcctataaaactattaaatgagctaggtcctacttacttttccactctcacctctcacttgtcattttctgtgttggccataccccatctgcattggtctccttccatttctttgcataagccagaatctgtcatatcttgaggtcttcacacatgctgtcctctcctcggggcatgctttctctttccatctggatgcacacacttttcacgatttccctcttttcaaggtcatctagtttttcaaaacgttacttcccaaaagaaactttccttgatcactcatctaaacagccttccccaatacatctttcacactattccctgtctttgctgctcataacattcaccaaaatatgcaattatatattgacctgtgtgttcaccttctataatgtttatctttgctgctagacttagaacatcaacacagggaaacagtcttttttgttttttaaaaactgtttttctctacatgttataatggtaaatggtaaacatatagaacagttgaaaggattgtaaggcaaactcttatgtacatattccctgtattaaacaactaacactttgctgtattatctttattgcacatttattcatctatccatccctctttctgtctgttcatccattcattcttttatcttatttcctaatgcatttcaaactgagttgaagacataagtacacttcacccctaagcacttcagcatgtatatcattattaaccagggatcaatattcatttatgattcttctttcttgggttaaaatggacatgtagtaaaatgcacaagcgttaagtgtacaatttggtgagttttgaaaacacatacacctgtctaacccaaacccctatcaagatggaaaacattattgtcactccaatgcgttttcttatgccctttcttagtgaaactccaactccactgaccccagaggcaactactgttttgatgtttttcaacatcgatttgtttttccttttctaaaattgtatataaatggaattatagaacatgcattccttttttgtaaaacttctttcactcaacatagtatttttgagattcttccaagtctcagcatatatcaatagatcattccttttattgctgagtagtgttccattgtatggatataccacagtttgtttatttgttcctctgttgatgcatccctaggctattttctatttttggctattatagataaagagattatgagcattctgtgacattctgttacattcatttatcttgttttttggctaccatgaataaagaggccatgagcattatattacatattagtatattcttttatcttatgtaaatacctaggagtggaatgtgggtcatagggtaggtataaacttatttttataaaaagctgctggacctttcttcaacataggtgtagaaagagtctgttttctttagtaacatcaaccagatagtatgtgaatttggcacaaagtaagtgcttaataaatatttgttaaattaatacacagagaaaataaatagaaatatagtgactgttctaatcctttcctactgtttactagtgaagtgtgactgtttacgaatcatttaagttccatgagccttcaatatccttttatgtgggaataataaaatgtgccttagatgcctgaaaaggttagtgctgaagggccaggggcatggggggagattttaggaggtgagggacaccattcatttaatacaagcgtgcccttccttctctccctgacctccccagtctgcaagatttcggcctgcagctgtcagggaatatgccaaagcctaggcccaggaggggtcagggtaggtgaaaggggaagaggcacttggatcaaccattggttgctctcaaatgtctaaagttggcatttatatacttgacttctctcacagtttctctccttcagatttaacgtctaggtttctctgattttaaaactgggttatttgaatgtcaaactttcgataaccctttaatagaggtgtccattaacctgtgctaaattagagcccagcgtccctggaaatacatgtgacacccacatgaataccaaatgccttcattaggcacagcacttacatgatgaataccaaatgcagagcccaacgcagggacacagatttcgcttcgaggacttgccaacacatctttgcgtttcctcagcggtaccggtcagccctgtttgctgtttatttccaggtgatgagatgtggcaattgtggcattggctgaaataaataaatggcatcctaatcaccaagttcagagatggagcagcaaaggaggctatagctgatcactcaggagtcagcaaaaggatgcccacttagtatgcaagacgacttccaaacacttcataaaaggcgataactttctttgaccaaagaatatattatttataagtgattccaatgccttcttctctccctccttcactgccatcctcctgccccccattttcactgtatgttgtagcacttgttcagtgatgaagcccctcgtaataaataatttataaagcaatttacaagtacattattcttagcaataagataagacctggaagaaagtgttttactgatacacacacacacacacacacacgccccttggcttataagtagcaagctatcagaacaccaataactaaggtccatgggcttggggtgaagggtgttataagccatagtgctggagcccttatacataagccatgtaaagtgtctgaagtgtatttgcataataaataagagaaaactcactaaaaacagccttttctcttaatccttgtacacagctgccatggctttgtccacatggcgtgatactaagtgaagacaattttcccttaatggctaacttctcttgagtacatccattgagccaggcccagtgttaagagttctcaataaattgtcttattttatcttccctatctctatgagatatgttttattagtattcctgttactggacaaagtaacagaggctgcctcccagtcttcaacattcagtctttgaattcccaatccagttaaagtcactcactcaagtattcattcaatgctaatatcctacaggcatttgataagcatctgtcattctttattctgggagctaggatgcatagacagatgatgcatctatagcagtactgcctaatagaaatacaatgtaaatcacaaaggcaagctgcatataaaatttcaactttccttttttaaaaaaaattagttttttggttaaattaaatttaaccaaaaatttggttttggtctgttgcacaggctgcggtgcagtggcaccttcatagcctcaaactcttgggctcaagtcatcctccaccttaagctcccaagtagctgagactacaggcgtgtgccaccttcctggcaatatatgtatgtgtgtgtgtgtatatatatatatatatatatatatatatatatatatatatatatagagagagagagagagagagagagagagagagagagagagagagagagagatagatagatatgggggtttcttttgttgtccaggctggtctcaaactcctggcttcaagcaatccttccaccttggtctcccaaagtactggggctataggcatatgtcaccacatctggatatttttttattctttatttttatttattttattttatttctttatttttgagacagagtctctctctgttgctgaggctggagtgcagtggtgtgatctcagctcactgcaaccactgcctccaaggttcaggcgattctcatgtctcaccctcccaagtagctgggaccacacccatgaaccaccatgcccagctagtttttgtatttttagtagaggcagggcttcaccatgttggccaggctggtctcaaactcctggcctcaagtgatctgcctgccttggcctcctaaagtgctgggattacaggcgtgagccactgcgcctggccagtatgtatactgtttttgttagagatggggtctcactttgttgctcaagctggtctaaaactcctggcttcaagtgatcctcctacctcagtctcccaaagtgataggattacagttgtgaaccaccatgcctggttataatttcaaaatttctggtagtcaccttattaaaaaaaggtaaagaaaaggttcaaattaattttaatggtataatttatttcatcaaatatatcttacattcttctttcaacatgtactcaataaaaacattattgatgagatactttaaattccttttcatcctgtcttcaaaatccagtgtgtatttttcaccctgtcttctaaatccagtgggtatttttcacttatgacatatctgaagtcagactagccacatttcagggactcaatatccacctgtagctagtggctactgaactagatggcccaggtttataggaaagcgaaggaggcagatgcctgggatgacatatcactagactatgacaattgcgattagagaaatcagcttaagctggggacaaaggtaatgaaaaaggccactcaaagactaggaaggaggaatccacctgaaaaagagtagaccaggctggggttcaggttggaaagcttgggccaaaagaccagcattctcctaacttcagtcattccctcactcccctagcaaaagttatttgctttctctgcttagtatttgtcctcctgtttacttacttttttttttttttttttttggtaaattgatttactttttaaacttaaacaaatttatttaacaatgggactttttggtacttccgttaatgggaaagcaaaattgactgttataaataaattagccacaaaacaaataccaagcaaacaaagcaaagttattgaattctagccatatttacttgcctgtgcaaagctttgggtttctgctttatcttgtttttgtttgaagagaaagaggagagagaatctctgttttgggcttagatgtattaagggctgcatttattctttctactaaaacaacccccataaaacccaaacaaaatatatgaagtaatggtttaaaagacatggaaaagcaataacaaaagcctaatccctggtggtaacaaacaagaccaggcttacaattctagcttcctgtctagtgaataatcagccctatagtaagtactactctaatcgtaactaacaatagaatcaaaacccaataggactaaattgttttcaagaaatttaactacattccagaacaaagataaagaatatttatgaaaatattttttaaaattaccaggctatagtgcagagaaagggaatccaagtggagcctgacaggcccctgaagccaaggaaacagatctgagagatccatgcagatgaaggcagctggtattggcagaacagagtactggggaggcaaaagctgcagagagtgagagaacattgaatatctgcagagggcttctgtcaagctttcagctaacagggattactacatgtgcttgtgaagaggacttagagttaggagtgtcctgtgctcacacagtgttgggaataatgcctgctccaaccagtaagactggaaaacctcatgattcatggggcattaggtaaagtacccaaaagggtcttgcctcagtagtggggaataattagccctataatgactactgctttgattctacctaacacttcttagaagcaagacccaaacggaccaaattgtttccaagtaacttaactgtatctcagaacaaaactaaagaatatttatacccaacaaggtaaaagtgacaacgctatacattaaatcagagattaccacaaatgcaaagtgcaaaataagatccatgattaggagaaaatcaatcaactgaaactgtaccagaactgatacatgttaaaataagcgtaaacattaaaacagttatgataattgtattccatatgttttcaaagataagtagaggcatggaagattttaaaaaagtgaaccaaattggagttctatagataacaactataatttaggaattgaaattatactggatgagattaatagtagattagatattgcagaagaaaattttagcgagcatttacacatagcaatagaaactatccaaagtgaaacatacagagagaaaataattaaattctaaaattatcagtgagctgtgagacaacttcaagtagcctactccagacatgtgaagaggaaggcgtgtttctcaactgattctatgaggccagcattattctgatatcaaaactagacaaagacattacaagaaaaactacacaccaatctccctcataaatatagattttaaaattatcaacaaaattttatctaactgaattgaactctctctctctctctatatataaatagttggagggagatatatacacacattaaatttatattggatatactatatctaactatatacatatttatttaatagatatagtatatccaatataaatagttggctatactatatccaattttacacacacacacacacacacacacagacatatatatatatatatatacacacacacacagaagtccaagaggagtttatcccagaaatgtaacattggtttaaaatttgaaagccaacctctgcaattcgctatattaacaaactaagacagagaaaagtcatatgatcatctcaatagacataaaaaatatttgacaaaatgcaatggtcatccttgttaaaaactcttagcaaactggaaatagaagagaaattccaagacctaataaacaacatctattcaaaatctacaggtgacatcatatttaatggtacaagactgaatgttttttgctgagagctggagcaaggcaaagacgtttgctctcccccttttttcagcattagcttagaggttcttgtcttgacaactaggcgagaaagagaaaatgcatccaaattggagagggagaatcaaaactatcattatttgcagattacttaatcctaaggaacccacaaaaatactagaactcataaacaagttcagcaaagtttcaggaaacaagtcaatatataaaaataaattttatttaatataaaactgttaagcttatggaaaaaataaaggaatatctgcatgaccctggattagtcaaatatttcatagatatgacatcaagtacatgatgtatagagcatattgacaaattagactttatgaaaataaaaaaaaacttctctccaaaaaacactgttaatatagaatcaacaaataagccacagactggaaaaaataagtttgcaaatgactaaggatgttaagcaccttttcatgagcttacttcccatccatatatcttctttaataaagggtctgttcaaatatggctctcttttttactaagctgtttgtttttcccctccttttattttcctttccctcttcctcctccttcttcttctcttcctcattattatttctttattatatattctagataaatttcattatcagttatattatttgcaaacttggctgggcggggtggttcacgcctgtaaccccagcactttgggaggctgaggtgggtggatcatgagttcaggcgttcaagatcagcctggccaacatagtgaaaacctctctctactaaaactacaaaaaattagccgggcgtggtggcaggcgcctgtaatcccagctactcgggaggctgagacaggataattgcttgaatctgggaggcagaggttgcagtcagccgagatcataccactgcattccagcctgggtgacagtgcgagactctgtccccctgccaaaaaaaaaaaaaaaaaaaaaaagagaaaattgcaaattaaaaccacagtaccactacacttttattaaatggctaacctgaaaattaccctatcaagagttggtgagaacacagaggtactggaactctcatacaccactagtagtggtgtaaattggtacaacccctttagaaaatggtttggcaatttcttaaaaagttaaaaatatgttatcatatgatccagccgtttcactcctaaacattttcccatgggaaataaaatcttaagtctttacaaaggtgtgtacacaaatgttgacataagcttaacttgtaaccaccaaaaataagaaataatctaaaagcccatcaagagacaaataaacaaagtgataaattaatataatggcatactactcattaataacaaggaataaacttgatacatgtgacaacaaccatgaatgccaaagtaattgtactggatgaaagaagccagccctccccctcagacaaaacaaacaaaagaggccaggcgctgtggcttatgcctgtaatcccagcacttagggaggccaaggcgggtagatcacttgaggtaaggagttcgagaacagcctgggcaacatggcaaaagcctgtctgtacaaaaatacaaaaaagtatacaaaaaatcagctgggcatggtggcacatgcctgtggtcccagctaatcgggaggctgaggcaggaggtggaggttccagtgagctgtggttgtgccattgcactccagcccgggtgacagagtgagacgctctctcaaaaacaacaacaacaataaacataagaaagtgatttggctgtaacatgcatgcaagggaaggatcaggaagaatggactcacaaagtattttgggggcttggctaaaatgtttttactcaattttggcataagttaggttagcagatgatatggttttgctgtgtctctacttaaatcttatcttgaattgtacttcccataatgcccatgtgtcatggacagtaattgaattatgggggtggtttcccccatcatgctgttctcgtgatagtgagtgagtctcatgagatctgatgattttataagtgtctgcatttcccctgcttgcactcactcagtcctgctaccctgtgaagaagaggcctgctttttctttgccttccaccatgattataagtttcctgagacctccccagccatgcagaactgtgactcaattaaacctcttttctttataaattaacagtcttgggtatttcttcatggaagtgtgaaaattgactaatatagcatattagctcaaatattagtttatgttcaaaagttttgatgtcatgttgggagcaactggaacttgggcaagttaaccttttcgaacatcctttccctcattactttaggcaaatgctaacatggaaatattagcatttgcctaaggtaatgatttgaaagcttaaatttgagaacatgagtcatttctcattctttcactttcctcatagcacataacatgatttgaaattattgtactttagttttagtttgatagtgctgatctccactccttaccttcccatcaccaagagtagaggtcttgacggctgttttcatggttttatctatagcacttgatacagcattggacacctaggagatcctcagccaaagaaagattaagaaactcagggagcataacactacatctgaaacacttagatgatcagcattttaaaaaaatgtctatttaggttcttagaacaaggctatggcatcaaatatatgaattggcttttctaccaagttcttgccaactgatcagatgatgaggaaagcacatgtggccagtagtctaactctgagttctcccaaagttcactgtttcaatcaaggtcaaataaactttttctgccttgggccaggttgagtcatgatagctttaaggaaagaagcaagtaaataaaatgttctgtctgatctgcctggatgaaccacagtcttggcaccaggacctgaccccctggaagggtcagcagacaatggcacagaagagattgttaataataaattataaacatggctgcagctaccatggggagaccctatatcccctccccagcccacacattcactccctggcctgttctgccccatgggcttaatccacatcagagtgaaacaaatccaataaaacgtttccctgagctaagagggagttcaatgattcattctcattcattctctctcttcctgccaaacatctaatcctagatgacgaaagaacaaaggaagaggcatttcaaagaagtcatcctcatgtgtctccctgctgctttggtgtctcacaagaatcaagaccctgccctgaggcttaccaggacttagcagtaaatgtcatttggatatggtgccattagtgtcctctcaatgataggacacgaatgtggcaccttgtcatacctctttgctgcagtctcactcactggggactaccatactgctggcaaagaggatattatcagagatggtatgtggggacagacatagtctctggcataagttggcagcacaattgctgaagatctcaagtggtgacctgggaaatagtgtcttagtggaaggaacactcttgcagtgccatgatttacatgttgtaaaaatgtcaagggaatgattctacacagatggtagaaagggaaaaaatcttcccagtaggtggagattgaagcagttggcattaattcctagggctctcattgcaaaacgcctcagactaggtggcttaaacaacataaatttatttcctcacagttttggaggccagaagtccaagatcaaggtgtggtattgacaggtttattttttttctgagacatctcctcttggcttacagaccccccccttctgtgtcctcacatggtttttcctccatgtgcacattcctgttatctctctacacgtctaaatgtcttcttcttataaagacatcagtcattttggatttgagttcaccctaaatactctattgtaacttaattaccttgttaaagaccttatctccaaatatgacagcattctgaggaacttttggctgggacttcaacatatgaattttgtgggaacacaatttagcccataacatgattatccaatagtttactttgtgtggaaagagaagtatcccaaggtgagactatatcttgattctgaggctgtggtcgatggcttggccatgtggtcagcagcctagaaggaaaaagactggaagattggggcaagaaagtcagaggtagaagtacatggatagacatgtgggaatagcaggaaagggaataacatttgtttcattcctcatctcactagaaaatgttactgtgaaagaggcactgaacaaccaagtagacagaatgactcagtgacattaggtagctttcatcgtgagccaccccaggactgatacaatgagcacatgggcagagtggccatagtgcagagatggaggctactatgggcccaatggcatgggctttcactttttccagccaattcaaatgctgctgtccctggatagttagcatgttcgcaatagtaatcaacaataagcacctaatatggcactatttcttggagagtccaaccagtcatttggtagcaagtccacctcaagtggcttcttgcaccttggaaaggtcagccaatagtccttgtggggacagacacctactctgaatatgagtttgcctttcctgcctgcagagcttgagccagcaccactctgcaggggcagagtatgtaatggctgatccaaaggcatggaattccatgcaacacggcatccacacagcattatgaagagaccaacttctcatggtgaagagggtgttggaatggattcttgttcttgtaatctatgaatttaagtggaattctcctagaattgttcagcagtatgagatccttgtgacctaagcctcccttcttcctacaatctttcataggtatcagaccagcattacagtctgaaagctctttccaccttccctaacccactctcctttactactgataaagctgttgcatttctagtcctatattggtacttgcttctctgaagactggagcaaatacaaattccttctcaaggaaacgattctccttccctcttgcctataatattggtcagctttcatgggtgaattcattctatgtccttctaccaccccatataatcctactaacaagttctaatttaactatgactgtgtgaaatgtattaggagagttttttcaccttttctttagaaaacaataaaataaaatgaaatattggctcaaatcacttaatcacttaataaaatcacagaactcttccgttaatgcattatgcataattatatttgaactttctgccttaggaggaaattaaaatttgtactaatggaaacattcaaattatttttaaaacttacctttgcaatagtggtagttagagatttagccattaatcttccatggcattgtatttgaaggattttgtcatgttatgcgacttgaatttcagtgacgtctaatctgattttaccatctaggaaaaccagaatatgaaaatttttattaatttaacattttatgttttaaatatatttcacttttaggacaatatatacccagaagtatcaaacatcaatctatggattcataaaacttgtgtataattgctttatttactatacttacaaattttcaattaatttaaatttagccaacctccatattttgagggtttccaaaataaagtattttgcccaagtcatcatagcaaacaattgacttattttttctaatttaaaaataactcctgattttccttaaattactttgtaaatatttccaatactacagacaataacaaatcaaagaaataaacaaataataaaattaagcatttatttaaaaaaaatccttgaaagcatgcattctctaatgtttacatttttaaagcaacttttgaagcttccagagaattgtgaggttcttggggacagaggctgggtcattcctcttgtgtttctgtgatccctagaaaggcagtaggcaggtagttagttttcaataactgtttcctgtttctgtcagatgctccccatccctctttgagaaaaatcttgctctaaggagcaaggacaatagagatggacctgtgtttcctgtatgggtcttgcacaaagagggaatgagaagaattttaaagtacttgctgaaaaaggctccaagcttttgatttttcaaaatttttactgctccggagctaaagcacaatattcagaaaatcataatgcctgcttcactatatttgcctgtgaagtccccatttgatcaaaataatgctagacagtttctctcttgatctgtttagaatcaagataaggtcaggtgttaattaatgttgaattaccaaaaattcccatggaaatgcatatgacatctacattataaccataattagctaattaaccaatcaattataatgattaatgtgatcataatgaatgtatggcaaatggttattaattcttagagtttccaaagtaaatgcattaatcacagttgaacctgtggtaaaatgtgggtgcctaattatctttctgaactctgggtgtgatataataattttcatctgcttagaacttttgccacacattgtcttattattttcctcacaacaaacttgtgaagcagttgaaggaaagttgtacttttattgttgttgtttccatttcacaggtggttaaactaaattttagaggggcaggtgattttcccaatatctcatatcttcatatttcttccttcaaatagatcttccaatgatcttagttgatacttggagttctaagcttgaacatttagacaaggctttccccataccttcccagatgttctgctacataatactatgtggtgtttacttagaaaactagtcaacttgtcatcatattacagatataagggagaagagtatttcaccttaccactgagggagagaaattgtgagtcatctacaaaagaaaagggactttgggagctggggttctggtgcaactactgtgtcgttgtatgtgagaggtggagggcatgtgtgtaaagaaccattgcataattttttgggaattttcctctagtacaaatctcatagcactgagcacagttccaagtacacagcagcaatgaacaaatgtgcttgctgaattaaagatacttaactggaagaggagctgaaaacaaaaccaactaaccaaccaaaacaaaacactgaagggtctttggaatcagataccaagccttagaatgaaaagaagacccttagagctttacattcatttattctctgattttccctggggaaattgtgtgactttggaatacgtgatcactatatatatatatggagcaagtcaacaaaggaatgctgtaggagataaacctggagcttgctccagcgtaaggcttggaatgggatgaggaagatggaggacattctaggtcagagcaaacacatctatccagggcagaagtgggagcaaaaacactaaggagaaaggccttgcagaggtcaggatagtgccaggaagaagaggagacatgaaggggcaggtgaccatttgagggagagtccatcatggaagaacttgaataccaaagaaggagtggaggcagcacatggtagaagaaaatcctagaatagcttcagctaggggtcacttttaatagcactatacaggaaatgctttcacattaaaaggttttggggtagtggatgaactttttgaggtcttgctctacttcaaagccaattactcttaaacacttcagaggcattttgaaactgactctgaacctggcacatatgttaatgaggattttggtaagtgacatcagcagtttcattccagtgagaggggctacccagaggatgatcagcaagtcaggatgatgcccatgttcacctgtgccctgcctgactagggagggcagctcttgccaactgaagggctggaggttaatatcagaatgtttataggtatacttacatgagcccacagttaaattctatgttgctttggaggaaattctattctgtggtttattcatttttaactaattatcaagttgtagtcataaacactaaagttaatattttctaaaatattatgtatattaatttactgtacagttcattcctcacatatttattcagtgatgttatcgtctgaatgcttgtgcctctccaaaatgtgtatgttcaaacctaacccagaaggtgatagtattaagaggtggtgcttttgaggagtaattaggtcttgagggctccattctcatgagtgaaattagtgcccttagaaaagggcttgaggttacatgttagccctttctaccatgtgaggagacagcaacaaggtgacatcttttgaagcagaggtcaagctttcatcagacactaaatctgctggctccttgattttggacttcctagcctgtagaactataagagataaatttctattgtttatgaattagctagtctaaggtattttcttagagcaggaggaagggactaagatgggtacttactaatctataatggaccccaggaagacaaagataagtacaatgtatttttccctctaggaactcttagtttagcaggacaggaggacatgcctgtggataagtgccttttgaaactggttccacctgacaactgcagtcctggctaaagtgagcagagtgtgtggaacagaagccatgccccttatggaccaggcttaactaggctgattcaaatctatgtgctttagattatgtaggtgagcatgctgggagaattttaccaacagttcttcctatttttgatgctatccagaaagttctgtcactatttggaaaatagaattttgtgtagtagttaagaatataaacactgaagtcaaaagaatctatgcttatgttgtgtataaaatgcacagaaaagtgcctggatcttggaatcttagtctggatatctccaatacagaacatgagacaaggttccaatgctaatgttttatgggaaggtgtaaatccaaggcagtgagagtgaaggaaaaataaagtggggctgggaaagatgaaagcaaatacctacgtgattattgtaccaggctttcatgaagagttggaaccatacattcagccatgcaggagatctgtttagaagcaactatgcttcagaataatcccaaacacccatgcttcagagaaatgcatgcagagggacttgttctgccagatcccttccttctcttgtcatctgtcaatgaaagtgctcagcttggtctaagaaatgtcaagttttgaggtggtgttgtgggagcaatagtactgctgagagagttgctggactggactggtcctagaaacatctgctatagcatcagtgtgctgcctggctccagcttggagtatcttgttttcgctgatgcctggttttgattaaaggcacatgttgtgttcaaaggcccctgctcagctcagcctctgtgtgcccttatgtaattagtttgtttaaactgtgtctctgattatgtcaggtcttgactgtggccctaagtacaagagtgtaataagatatacctattaaacagatgttggactttaatggatatgttttgaacagtcaattggaattaaactttcaataactactgtagaacaagaaaatctatctctttacattaaacaaagcaatgtggcctcttactggttctctgaagcagtgattttcccagatgggctgtggccagaatcaatgagagaaacttttacaattcagatttttgggtcctcaattgccaagtattttgatttgtggctctagggtgaaatgtaggcagctgaatttttaaatcgtcctaagcatagagacaatcagagacggtaatttatagacagacgtagtcatttttcaaaaatcaatttttgttactatagatcaagtatttcattcacccatttattctacatcaattgatcaattcattcccttatttctgcatttattccccattagtttaatattccctgattacctggtaagcataagttgctggactagactccatccagatacaaaagatgtctacctaagtaagacatgcttctgctctagaaagtgtttatcatttagctaagagtggagagtccaaatatctattcagcacctggtctgtttcacgcatgagctacttgcttttccatttgatatcttatgatagccctagggaggagatcgtattatctccattttacagatgaggatactgagttcagatagtttaagtaaactgcccactcttactctgtttgtaaatgctagagatgaggagataaaatgtgtgtaaagaaaataagcacatcaaaagggagaaatcaattatcttatgagtcagtccagataaggggtacagagggttagtaaaagaagaagttactttcagcccaaccgggtaaagacaactgcctaagcttagaagaacaaagtgaaggacatttcaggcaaagtgggcatttgagccaggagttcccaaacttgacaggtgatttgaatcacctgggagctttaagatgattctgatttagtgactctcaggtggggccccagaatctgtattatttataagcacctgaggtgattctgaattatcagccagagttaggaataagctacttgttaacagaatgaatagaggcagaatagtattttttaagtcacatactaacattgcaacttaactctggctggaattgagtcattcaggaggaatgtgttgccctcaccttctccattagactcatcaacaagtcctgcctgtcctgtacacagcctactgctctaattctgctctcctttctccagctccattgctactatgtggtgccactcatcctgcttttgaattcactacctctaatctctgtcccttcagtagacacagcctccactcacagcagctttaactgtccttctaaaattcaactgattatactacataatggctgttacccacttaaaaaccttccacactcttcattgttaaattcttcagagtgggctttaggcttttctcaaccacatcaactccttcattcatttgttcattaatttataaaatgtacttagtgtctatgatgtgaaaacaccgtgctagacattggaaatacatgaaaagaagacacaattccttttgttaataagtttataaagtacagtaaatactgttaaggggtaaactcaaggggatgagcaacacataagaggagctgatgaccttacctgtaagagttggggaaggttttctggaggatatgatgcctgaaagacaggtaagagaaattcactgggtaaaaaaagaaaggcctttgtgaataggggcacagtaagaggaaatgtggtttgttcagacaactgtcaattgccctgcaggaatagcaggtgtggaaagagtaagtattgagaaataagcataaatgtaaacacaattctgggattgatttgggtagagtgggtgcaatgttgacatccaaatctaactgggtagattgaagtaaatgatcaaattttgtattttaaatgcaaaggctcaatatattgaactaaaactcagttatgctccaggagcggggaagggtgtggcttaacatcagcagtgcatgtgtaaaatgttcagagtggaactaatgtcagtggtatgaagtggcccctgtatggacccagtcttggaacaaaatgtccagaagtcctaggacactggtatccttgtgttcagggttagtatccacagtacaagtggcacagagaaactgaaatctccaaaggcaggttactggagaagaaaagaaatgctaagccataacacacatgagaaaatcttggaggaatcaggatggctccttctggagatctttaccagctaattatccagagtgcttccttgtggaagagaaattgacctttggaactctagggtgcagagctgagcccaaggggcaatagtcatgcataggcaaatttctggtaagtacaaggaaggactttgttaggatgacatttgttttcccaaggtgtattaaaggagaaccatacatctaagaacagataatatgctagtgcctttcttatctctactaggtttgattctctgatcaaagacagaatttttagtaaagaaagggttgtctgatttccagtggtcaggagagttaggaggatgttttagcacatgcaaactttttttctgtaaagtgctagataaaaaacaaatgaatgtggctgggatctaataaaacttagtttacaaaaacaggcagagggcagagtctggcttatggactgtacttggtcaactcctgttttggcagatggtgaggaccccaccactgagattattcaagtagaattgggggtttgcactaaaatgatcttcttaagagatgataactataaatgcaggcaatctctgcagaggacatagactagtggggccttcagaataacttagcttaattctccctctataaaaaatgaaactgaagctctacctcccccaaaaaaggatttgcccccaaatgtagaattaggtagtggtgtttgctatcctgaaagagatctctgttgctcattttacttatatctgtatattcaagagataaaaacaaacaacaacaacaacaaaacacttgttttttggtttgtaacaaggcttccaactttcctgcctttgattaaaggattttctagctggtgcctgagctttcctctgaggtgtgtgagcctgctcctctctgtagattaacatgtgcattatgaattcactgtcaatgtcagcaggctagcttttccagttttacaaacgtcttttctttcaggagctggaaacgttctcaaaactgtcctgaaagcaagtaatgctttcagtcgttgtcaccttcgtgaggaacatgctgcaacttcgctttctgacttcattctccgggtgacatttttcacgcaggctctgacagagacagcaattataaagacatccaggttggcattcaaggattcttgaagttaacaaattgtccagggataaatgacaatgaagttggcagtctacacatttcttcatgaaaatgcatgctctgggggatcagaataagcctcagaaggagatgacacccatgctcatggtggggcctgtcggagtgacccccagggcttgcatcttcaggaagctatttggcttaggtcagctggactgtaaacttctgggcagctatcaaggatcagaggaaaacaatgaaaatatgtacttaaatacaacgtagctttttgatttgctgacaatatctaagtgcaagaatggtgtttattcaaatctaattccctcttgtgtatattcaccattcattggctctcatagcccaaagtctgtcctctctgtgcagcccagccttcccaacgttccagtgttttggtctcatcccatctctcctccattcaagcatccacttttccaactgttgagaacacttcacacagtctgttccctttacttggaattgcctcacaatttcccactaagcattcagctcaaaaggcaccttttctgtgaagccttcttttcttattctcatgagaaccatctccattcatgaacagagatagaaggtgggggatatcaccagtaatgtcccagaaatcgaggaagctttaccttagaggataacagttgtatataattgagacccacaccagtttctagaaacaattccttatggtattgctgagttcatcatgaagcaggaagcccaaaagtgcaccaccaagtcttgatgggcaaaatcagtaacttcatgctaccgagtgctttgtgtgtgtgtgtgtgtggtgggggtggcaggggcgggggggactgattttaaccttgcatacatactcactttctttctttctttctttctttctttctttctttctttctttctttctttctttctttctttctttctctctctctctctttctttctatctttctttctatctttctctctctctctctttctttctatctttctttttctttctttcttttgttttctttttttgatacggagtctcgctctgtggccgggctacagtgcagtggcgcaatcttggctctctgtaatctccatctcttgggttcaagtgattctaccgcctcagcctcccaaatacctgggactacaggtgcctgccaccatgcccggctaatttttgtatttttagtagagacacggtttcaccatattggccaggatggtctcgatctcttgacctcgtgatccacccatctcggcctcccaaagtgctgggattacaggcgtgagccaccgtgcccggcccactactcacctatttcttacaacttagaatctatgatctatgatagaatctatgagatgtgctattaggcaaactccattttaccaatgaataaatggagaaatagtcttagagctgttccaaggcttacaactagtaagggtaataaacgagccaaaagaagagctcgggcagccaatgtgaagagaagttggattggatcagggtctcaaagcggaaagactgaagggatccctaagcctctgagctcatcgccacagtgcactctccctggaaatgtaaagatgtgctgaggatatgactgtgggtagccttccccagaccttctttccagggtggtggctgaagctggttggagctttttctagaaatgtcctgactcaatctctcagtcacactcctgagcacagaaaggcttgcgctgtgcctccctccagggcacctggtcctggatgtgacttggaaagaggaggacatttctgtagaccaggcagagcagagaactaggaggtggtgggaggggtaggagggtgagtgaagcggtgggcaataaagggggtggggagtgggtggggggggtccatggagcaaggatagctgcagcttagagattgtgagaatgattatcttttctccattaaggataatgacagtgagaggaggcagccaaatgcctaagcagataggggtgggtccccagtgaaaccccgccttcaagccaaaaaaacagcctgaaggctgaaagactggactgctagtcctggatgaaacctgcaacccagagcaaggacttctgttcctgtttacctgcccttctccaaatgattatgaatgatgccttttaactaatggaatgttgccttttccaatactacctatggcctgtctcacccctattctgagcccataaaaagccccagacccagctacacagaaaggagagaaccacctgactttggaggtgggcaaccactccccacccctgccccacatcccctctcctttgagagccattctgtcactcaataaaattcttcacctcccttctcatccttcaatgtccagcatatcctcattcttcatgggtgcgatacaagagctcaggaatcaccaagtgcaggtacaagctaaatacaggcaagctggggcatgccagtgtgaccaagcgaggcccaggtggggcattaccagctgggggtccctggcttgcaaagtgaccgagaagaaaattcctacagcaataacaatgacagaatttgtgagatgcttactggatttcagactctgcattttgctaggcttattgggtttattcttcatcaccattctcattctgcagatgacaggggtaaaactgagagccatggagctcaaggctgcacagctaaaggagatagggccaggattcaaacccagctccctcagcctgcagagagactcgtcctgtgctgttcagccacccagaccaggccaagggaagatgtttttccctttcagcatctttcctggtaatcagcactcatgagacctacagctgtcacaaggtatcatgaagttctattgggtgtaagaaagagttgactacatgctaactctgtcttggtaagagagctagactagccatgctactggtgagtgatacagcagtatatgttctcatcaaatatccagttcctgatacagggcctggcatcaaagagacacacgataaatgattcttgaacacattttgaaggaagtcatagcgaatgcactcagggggaccagctctgacctttctgccagtgcttccccaggctcagataacacatatttcaaattttggagaattctgataccagattccaaagggcatccatctcagattccaaagggcatccatctcctcctctggttcaaatgacactctgcctaggtctgtgaccaggtcatctcagcatctcatccacctccttccctgctccggcctggagtcctgcctgctccacccacccaccctgttaatttctagctctgaactagctcagccacttctctctctgctcctattcctggttctgtaagttctcctgaaaaacaatcacacatgtgtgctgatggttgtccttatgaatgcgtattccatctcatcaaactcctggactttgagattatttgacttgttttctttcggttatttcccgtcaaccaccacagtcagagtgtgagggtgacttgggatggggagaggagggacgtgatggaagaggtgggaaaaggttttgtatggggttgtaggtgatgttttaatgttttgcattgatgaataaaaatagttgttaccataacccccaaaacgaatggacccataactcttattttacacaatatttttcctactgtggacagattcatcatgtttgtgacacttaaaagctgttttactctggctgctaggtgggatagtgtatccccacatctctctcaaagctcacctgtgtgttctaaaacttcatctccatggcacattttgcatcctcttatctcaaggttgttgaagcagatttaagagctaccttccttcctctcagcacatggacttgcaactttatctagcggggattctcgagcttaggtgtattaacactcagatggctgagccctgccccacagagtttctgattcactaggtttggcgtggaacaagaatttgcatttctaataaattcccaggtgatgccaatgttgctggtctggggaccccattgtgagaatgactctatgacacctatccttgccttcttaacttctgtctcagataaacagttgtcctctcttcttttggcagctaacctctccagttagggacactaaccatgtctcctcaaagcatatgtagaaaattcactatggtcagggattgaactcaatctcatgcgttcagcagtaagcaaagctgactcagacactttagataagaagagaggtatcatttggatgcagatacatatgatcaattctgaattggttgaaagtgttgcttttaccaaactgatgacagtgattatctacatgatgatgaaatttatggatagatgctgaaacagttatatatatatataaaaaaaaaacaattccccaaagattgggaccactacgaagaatttgccttctttaaactaggtaccccagtagagaatgttattttccttttgcaaactgatctgcagtggtttgtggatgtcagcttgctatatgcctaatagagttgtctattcctcaattccacatcttttgcagaatatttcagtgagattcaacctcaaaaataagagtaagaaaaaaatacaggaaggttggctgagcagtgcagcacctacctatggcaactcttaaatcatttgatatttttgaagcttttgctccagtagaaaactcagacctctgagttggatggaggtgaggggagtacaaaaccaacaccaggggttccttgcagcagcccagaaagcacttgtgaatgtggcaggaaatgagatcttaagtcagtgcataaaacaatcaaatccatcacagccttggaatggcccttataactcagggactgtcaaagccctttgtgtgcacagaggcagtcgtagaaggagtgacgaactgagctcagagtctgctaaatctattctggcagccagaggaatatatttccaaagccaagtcacatcattttccttgagctcatttgactgcaggctaagaagctattgcagaaaacaaaagtatggtggaaggggtgctggaataatgaatattaatgaacttaattctctggtttggggttggcttgtactggtaagatgcaaaggcggataaagaagaacgaattgaaactggtgcttcaaaatgaacagtcttggccactcatctactgatctaatacatgtttacagtgtgcctactatttgcttgctcctgggcttggcaaagatgaaaaacaccaaccctctgtcctcagggacttcctggcctgttggagacacagatgtacatggtatcatgacaattcagggctttgctgtccattatagagaacacatacaaactggaggggaagtcagagaaggcacagcagaaggtgcaaatgcttaaacaaagcttccctctggcaggcatattgactgaccctccttgagttatgagcttgagctttggttaaagctggcactgcaaagaaacagtagctagatctcccggtttcccaggagagtcttgattatacacgtttttcctgttgccccagttgaattgtgtcttcccaaaataaacgtctgaatcttaaacccccatagttgggaatgtgatcttatttggaaatagggtcttcgcagatgtaatcaagttaagatgtggtcgtattgcattagggtggccctaaatccagtggctgatatccttataacaccaggtgaaaacacaaagatagaggcccaatcatagaggggagaaggtcatgtgaagatggaggcagaaactggagtggtgaagctacaagccaaggaatgccaaagactgcaggcaaccaccagaagctagaagaggcaaggaatcattcttccctaaagccttcagattcttccctattgacaccttgatttcagacctcttgtcatctgaactgtgagaaaataaatttctgctgttttaagccacctagcttgtagtacagcaagtcctcagataacgtcgttttgttcaatgttgttttgttaaaatgatgagaaaaacataaattcctagctggggccactttgcatgttctccccaaatctgtgtggcttttctccaggtactctggtttcctcccacttcccaacactgtgcctgttaggtgaattggcgttgtctatgtgatctcagtctgagtgagtgtatgtgcgcaagtgtaccctgcgatgtgatggtgcccttgccagggtaggtttctgccttgtgctgagagcttccaggacaggctctggccacctgtgaccttgaactaaattaagtgggttggaaaaggaatgaatacatgaacacagactattgtaaaataaaaatttgcggctgggcacggtggctcacgcctgtaatccaaacgctttgggaggccaaggcgggcagatcatctgaggtcaggagttcaagaccagcctgaccaacatgaagaaaccccatcttgtctaaaaatacaaaattagtcaggcacggtggcacatgcctgtaatcccagctatttgggaggcagaggcaggagaatcgcttgatcctgggaggaggaggttgcagtgagctgagatcatgccactgcacgccagcctgggcaacaagagcgaaattccatctaaaaaaaaatttttaacttgatgttgcagtttccaagaacctatcaacaatataatctgaagacttactgtacttttttacaacagccataggaagctattacaactctcaagtttgaattttgattcagaacatgtggtgtctgtattttagtgttccatatgatctagaataagtctgaggagataacttctagcacttttgcttccccttttctctccctgccaaactcttcctaaattcagttccggattaggaagatcacttctcactccacctggcagggtcatcttcttgactgcacctctccagtttctctctgagactggaaagacactccagagataaggcttgtcctaaccaatcagcactcagaaaacatctattgactggatttgatgtaaggtgggctctaagtaaagcctgaatttattaatcctccagaaagtttactgacctctctgagttggatgaggccagatctaataatgagtatgttccagactactaaagacaagcatatttatgactatattcacccaatttgggattgcactcttagactactgccatttacagattacattagcagatacttttggaaaacaatttggcattgtcattagtatttataaaatgtttgggttctttgactcaataattaaacttcagggaaactgtcctgaaaacaaaccaaaaattcagacaaagctgttgctacaatgatgtcaaaatgatacaagaactgaaagtaatctatatgtccaacaacagaagaataacttagtaaacaattatagtgtgttcataaaagagactattacacagctacttaaggcagtgctgttgaacgtcatgtgttaatactgaaatgctttaatatgctaagtaaaaggaagacgtttttaaaaattatatactatgatgacatcataaagtgtccgctgaaacttggctggaaggaaatatgccaaaatggtaattgtatttgtgtttgctcttatgaaatcccttgctatgtctgcgtttgaatttttctgcaatgttttcatttttgaatttttttttttgagacaggatctcactctgttgcccaggctggagtgcaaaggtgtgatcacagctcactgaagtctcaaccttctgggctcaagtgaccctcccacctcagcctccccagtaactgggactacaggtgcatgccaccacacatggctgattattattattattttttctgtagagatgggatctccctttgttactcaggctggtcttaaactcctgggctcaattgatcctcttggctccatctcccaaaacactgggatgacaggcatgagacatatttttgaaatttaaaatacaaaggaatagaccttcagattcatttatttatgtgcttaaaattgatagaaaatagcaagtcatttcagtctattcattaattaaatatcagttgctatttcatatctatgtgcaaaagaatcttgtctatttcacatgttccataggaaaattatcttcctttaaactatgacctctgagcaccaaattcagtctactgcctgtttggtaaataaaggtttattggaacacaaccacatccatttactttaggctgcattacaacagcaaagctgagtagatcttacagctctaaagcctaaaatatttaatctctggctctttacagaacatttgcctactcctgcattaaaacatttttccattctaacttcaaataactccaattggtcttttctgtcgttcctgataggaaagcctgtttgagcttttggcatgggcatctgacattagctgaatccatagaccctggccttgatatgtttaccctggcatttataatatggctcagtttggatttggtggaggacactatgcattggtgggaaattaggaatcttgttttgttttgttttgtttttgagataggtcttgctctgtcacccaggctggagtgaagtggcatgatcttggctcactgcaacctccaacttatgggctcaggtgatcctcctgcctcagcttcctgagtagccgggactacaggcatgcaccaccatgcctggctaaccttttgtatttctagtagagatgggttttcaccatgttggccaggctggtctcaaactcctgacttcaagtgatccacctgcctcagcctcccaaagtgctggggttataggcatgagccaccatgccagtctaggaatttggtttttaaagaatccttaaatcctggagtttggatctctggacacctccccctatcccaaccaaataggttctgggtaactaactcccactcccacgttaaatccactccacagcattaaaagaatggtccagagtattggtatttttgttattatccactccaaaagatacaattgaattcgattagcaatatagcaggaaggctactgctccagcgactgcttttgtcttaccccaaagcagctcaagttcattaaaatcacaattatctgactcttaattaggtgagataatttaattaacaatgcccacttaattgtcgatggcaggaaactgagacgagcaggctccatggtggctgaggcaacttagcttgaaatatagtggatggcattctgaaccagccggctcagtgagctctgtgcatgcacttggcatgtgaaagacctgagaaaagtaaacttggctctcattagaaaatctaattctgatctggaatggtgagggtgaaggatttatagcatgatggccaaaataatgatcctgaatcagctccctaaatccttgtcattcattcattcattcattcattcattcattcatacatacattcatttactcattttctatttctccacttttattccttctcttgtttcttccttctctctccaccttccaaaatctattaaaaccttatttttgttctattaagtataaagtgctttgttggataccaaaaatgggtaagaagactttttttaattttaatttttattttttatgggaagaggcccgggcagtctgaatttcaagaaaaggaatgatgatggtaactttgataaccacagtttattgagtccttatcatgcaccaggcaatatgctaaatgctttaatctcattatcttattttatgttcacaaacccctgtaagctaggtattatcatttgcattttaccaatgaggagaaactggggcttcaggtgataaaggaacatgtttagggtcatgtagccaataaaggacagaacctagatgcagcacagatacctataatgccgttgctttcaaacactagataatggttcccttgcgcagctcttaaacccacagaacggtacacaccccacagcatccctctcaaaccttgggacctccagtccttacactgcttactttagtgcaggcatacctatgtgtccggcttttaaaactcataaccctgggctcatgggggccaggtcctttctttttaagcttcttttcttgctgtttcaaccttctgttgtgggatgttgctaaagaaaaaaagtgttcatgacacttgttaaagatggcaaggaagactattcaaggtcagggactaggatgggaagtatagggaccattgcaatggggtcttacagtgggggagacagactggtctcaactctgactccagcaagcgtaagtggagatttatagccaaggagcaaggtgaggggtcaggagatggaaaattactaagagacatcagggatagggggattctggctagactgacttgataaaattcttgcttaaggcaggccagagtgggggataaggaatttgattagattaccaaggatgagagattttcactaaactgaccaagcaagagtctgctaaaactggactaactggccagagtcactagggcaagatcagagccaaagaccagggcctagtaagaaagagaactcagagaaacctgactcaagtcttgtcaagggagagaatgacagagtccagaagggcggagctcagggctcaaagcaatgcacttctgatcctcagtggtggtgccattcaatgacttcggcttcaggtcctgtgttttactccttttgccttgcaccttcgattatacactctttcgtggacatacaaggactttgaaattgttcaaagtctggtaaaaaatttccataaagtacttccatagcttttagcagattctctaaggggtccctatgagatttaaaaaaaaaaatctagactcctcataagtgtctctcagagctgtgacctacacactcatggtgacttgttaaaaatgcaaattcctaggccccagtctggaactggctcagggattggcaattcctaaaacgcccagaaacctgcatttttaaacaactatctcttattaagaaatgcctgatcttcaaggtggcagcaccaagctgtgatgacatttgaagtcctggattgaaatcttcctattattttgctaggacctgggcttggaatgcatccagcatcctgctgaggcctgggggagctgaaggggtgggggaagccggctgtatgtttgcaggtgcaaacatggctgtatttctcacgtggccttttccctggggctttattttgtccagcaagccagcccagtttccattgttttcaacaactgtgattgctgccagtgtgtagggaaatgtgaactctaaagcttgattcaaacactgtgaccagcttttattccaaacagcagcccctagggctctgtttgcaaggcagccccgaggcctttgaggccagggtcacagtttcctctgtttgggggcagaaggagcacaagctgacctttccctggctctctacagccttgtaaatgttgaagtttgtgtagtttgctcgttctttacaatcccgcagagctccttgggtcagtttcagcacagggagcgctcgactattaagcatttttgaggaccctgggcaggaaatacccacgttggccctcttgcttgtagcaccaggttcaaagctggtcaggaggttatgtcccaggtgctgaccatgattatactgctttgggagatgatctccttgctttaggtcacagacaagttagtgacacaactagaccccacatttgacatctagcccagtggctcagttctcagccttctttgcttccaatggagaaccagtcacccatacagcagaaaatctgacacattctgtccctcagacctgtgggatatagaaaggctattttcctgttgaaccaacccctcccatgcccctttcctctcccaatccactggaccagaaaatggtacaaactctaaaaaacatcagacattacacttgggtcctagtttttgagggccaatgtcctgggactttctccccaagtttttcaaaaacaatcacataaaagcgaactattgataatttaatagatatttattccaggtagaactccacacaaggtaaactataatccctagagattacacacttccttcttcctcacctcaattcattaccaagtcctagtaatgttaattccatttacctcttgactccattgaccgctgtctatccacagtccccagcctggttaggtttccaactcctgagcttgaatgattgaaatagcctcctacttctgttcagtttcactcctacctccaaccccagatccattctctacaaagcaggtagggctatattttctaaaatacaaatttgattatgtcattcccagcttaaagcctgtcaagagctttagaaaatctaccataatgaggtccccttgtgatagggttcccaccaactttctaagcctgctttccttgtcttctatgtgctttctgttacatttctagaaaacgctgtgctatttctcttcctttccctgctcaacgtctagatcatccttcagagctcatcagaaaaccctccctctgagaacttttcctgacctcccaactggtcaggagtccctgttaaagccttatagcacttatcagcacttaccaccatctatatttatatattttcatgtgactctttaattagtgcctgcctcctctgtctcgactgtgagtcctcagagggcagagactctgtttagttacatcctcctttttccctgatgacagtcactgtaccaaactcagagatattcattctatttctaatgaatgagcctaatgaatgaggaaaagagtaacttcctacattaaagaagtttactgactgggttggaaacattgaaatcttcctctcttgtacttgctaagtgagccctaggatttgtatgacaaaaagccatatatagctcaaatctgctttggaggctttgtggggccactaggtcagcaagaacacctggcttgtgctctgaaacaattagcctgacttgggttgcattggattttgttaaaacatgtgccgattgctacgaaaactgtttgcatataatcaatcttcagctgcagagagatgtcgagtatgggagggcgtgtcacgctggctgtttataaactctgcacgactgaggactcttccccaacatcccagagtctgtagtccttgcctgccctttcccaaagcaggagtgcccttctggatgagcccattgcgtgaattattttccttttgcttcctcaaaatcaaatgagccaatgtatttggggccccagggtaagggaagaatgtgagacacattcctggtgtgtccaagaccaaattgaagggaggtccaataatgtaaggtcaagtagccataggagtctatgggctgcatgcttctgtacttctctatgcctcattcccctcatctgcaaaatgggatgagagtgattcctaccttgtcaggagataggaaggcctaataggaatagtccatatgaagcagtgggaacagtgcccagcacatagtaaatactcagccagaggtatctttggtaaaacttcatcaaagacactcaagctgactgctggtgaaggtggagagttccctgattccccttgtaggacctctgattcccctcataggatgtgcgacacgagtgtggctcacctgtttcatcaccccacagctcaaattcctagggggaacatgcagacgggcaagtgcagaggccggagtgagtgctttgggctcttgaccccacggtagtgtctatcggtgagtgcctgcaacaccagtgttacaaagctctttcagctttaccatctgcagacagctttgagtgttaatcagctcaatggaccctctgccttattgcaaaggaagagggccagtatgacagccttctgtatcccaagctcttgtccagtgtcctggaataatcagatcacatgtgggcttgaagaatgagtgcagggttttgagtggtggaggtggctctcagcgagactgatgggaagctggaaggtggaggggtgggggagataatcttcccctggagtttggctgttctcagctgaactcctctcaacattcaggtgccccttagctccttctctgctgtgccaccctgctgctgtccgctgctctctgccactctccgtggctcctcttgatgttcagctgcttgtgtgtgtgaccgataaggtctcaggtttatatggcagcaggatcagggggcatggcaggccaaaaggcaagtttttgggtgcaaaaacagaaatgcctgtcctcatttagggctgcgggttttcaggcttgagggtgaggcctttgctggggaaccaccctcttctacccagtatttccctgactcctatctggataactggttctcaggtctcctgttagtggctaccagccccagttggtaacacaatcactggggagctgtttaaaagtacaaactccatggcctcactgaatcaacattatcctagaaattctgaccgggacatgtgtattaaaaaagaaaggtccaaagtgaagtaactcaggaatggaaaacaaataccacatgacctcacttacaagtgggagctaagctgtgggtacaaaaggcacacccagaatgagcattggagattcagaatggggagggtaggagggaggcaagggatgaaaaactacctattgggcacaatggatactacttgagtgacaggtgcactaaaatctcagacttcaccaccagacaattcatctaagtagccaaaaatcacttataccccaaaatctattgaaataaaaaaaaagtcctcagttgagtttgaaccgtaaggaccatcaatgaccactgcacagtttctgagtgagatttggacaagtgtctcgctctctttgtacctcagctttctcctctttacttaatgttgtgtcggctctatgtctgtttcatagcaggtcaagagagaaactcttggtaacaccagtgcttaacttagagcacacttgctttacttaaatatatgtattgccatctgccaaacaaaatgacaacttttatctctgcttgttcactttgtgtctttgtctagatgcaaatatatacttgaaatatcattcgtgttgctaaatatccacttatttagctccttcttttataagcatgcttctgtgttcccattttagctagaaaattttaactgtagttgttgcataaaatttcagtgactatatatatatatatatatacactaatttaaattaactgtatctctatttttggatggctaggttgtttgtaagttttctcactactataattcattctggaatgtgtattttcaaacatatagtttttctatatttaggtattttactgagtacattcccagtattgttattactgaattaaatgtatgaactttttttttgtttgtcttggcaatcaattgccaagttattttctgaataagtgttgccaaaatatactctgccaaccactaattaatgacagtttcatagtctctgtgccagcattcaaaattagcattttattttatatttttactaactgaatatacgtgtggcatttcatagttgctttatttacattttaaagcgtactttatcaattatatatatacactccttgcatgctatgtcaaattcccatgtggtggtataactaccaactcgataatacatagattcatcaactctgttcatcagagtgactttatagggtttatgtcaggaattgcctcaggtaaggagaataccactgttgttctctctttagccagctgttttctgttacaggtcctgaaggctggggctggcaagatgctgatgcaaccagggaagtggggcaacagacctctctgccacccagcccagagcctggcttaggccccaggaaatttgcctcccacctctctcttcctaggcccaggtcccagcctcttttcctattcaacatctgcaccaaccctcaccttggtacagggagctttctacacgctcattttcctcattagttggttaacaattcattaaatcaacaaatatttattgggcacttaccatgtgcaggcaatgtgctggggcacaggctacaatagagagggaaaaagcaggtgataaaacagagcttgtctccctggatctcataacccatcaggagataaagacgtgtattaggttgccacacacaactgtgtcaatcactctgcctcaaccatctagggaccttcaccacgtgaacttctttctgcctctgggtgtttgtgcatactgccccctgtgcctggagtcctcccataactaactctgtctgctgtgcatggagtcctcccataactggctctgttcgctgtgcctggagtcctcccgtaattggctctgccacctgtgcccagagtcctcccataactgactctgtctgctgtgcctggagtcctcccataactggctctgtccgctgttcctggagtcctcccataactgactctgtctgctgtgcctggagtcctcccataactgactctgtctgctgtgcctggagtcctcccatggctagctctgtcctttgcacttggagtcctcccataactggctctgccccctgtgcctggagtcctccatggctggctctgtcccctgcgcctgcagtcctcccataactggctctgtctgctgtgcttggagtcctcccgtaactggctctgaccctgcccctggagtcctctgtggctggctctcctccctcttcctggagtcctcccatggctggctctgccccctgaacctggagtcctcccatggctggctctgccccctgtgtctggagtcctctgtggctggctctgccccctgtgtctggagtctctgtgtctggctctgcctgctgtgcctggagtcctcccatggctggctctgccccctgaacctggagtcctcccatggctggttctgccccctgtgtctggagtcctctgtggctggctctgccccctgtgcctggagttctctgtggctggctctgccccctgtgcctggagtccttccttggctgcctctctcactccttccaactctgctcaaacatcaattttttaggggatacatctctgagaatggtgcacacaatactactgggctcttcttcccaccagtgctacctttcccagcctcattttcctccgtagcacttctcaccatccaatatactaatgaagacttgtgtttgcttattggctcttcccttcactgaatgtaagatccatgagggcaggagctctgtgtgtttttttttttcattgctatgaacagtgcctggcatagaggaacctcctaataaatgtctcctaataaataaaactgaacacgtgaatgaatgggttttattctgattcccacataggtagggggcccctggagaatttgtatggacatttgttggctgcagtgggtgcaatgggaagatgagtggtggacagggactaggggtgggaggatcagtcttttctagggccctgggcacactcctagtccttgcaataggactggcaagagcatctcagaactaaggctttgggtcctcctggagggaaaccctgggctcctctggcagtggttctgccccttcaccagacaggcagggactgccattgatttctggagatgctgaaagattcctcctgcagccagaagcagagtcagccaggaaggctgcgatttccagtctgtacaattaacattattatggaggtgtaatctctctaattggtttatttcatcaagatttgattgaaggcttctcttatctgccactgcagcctccctctacctaaggctcacgaataataggaagcaaaatgtatgcctgactcggcctcctcctaaagagaccagcccgtaaataaaacatctgggtctcctggggaggcgacggcatgaagggctgtgagcgggaacccactgattgatggagacaggagagtgttttcttaagtgaggcagggagtgatttctcctctggacctgggccccagagctgggtttctctgcaagagcagccagcctggaaatggcgctggcaatggaggaaggagggtggcagggggatggctgaagccccggcacactggcttggccttttgtttttttctttttcctaaccagacttctctgagaagaaggaagaataacttatgcctccacaggtctttccctgacaggtgctaacaggtcttcatgttgtcatgtaattaaccaacaagtcaatgatttttcagcaacacccagagagaatgagtttatgcccagttctgtccctaacttgaccaggctttagctccttgtctatgtaatgaagattgaacataatatcagagggcacttgctctctccagcagcaaatattgttgatcgatcatagctgcagacccaaaagggagcctttccatgcccagagagccatctttagtagacgaagattggtacaggagaattggaacctcttcctcctccctggaacccccaagaaaactctctccctcttagacgtaagagaatgattttgaaacctcagtctgattccaacacagtcaccacagctgagagttttgaaggaagtctttttcagaatagcattcccttcatgatatgcagaggtggtttgagttttaggaaatgcctaatgatagcacaggacagaattctaaaggcaccagcaagcagcaagcctatcagaaatagttgaagccaggcatggtggtaggtgcctgcagtcccagctactcagaagactgaggtgagaggattgcttgaggctaggagttcaagactacagtgcatttctgattgcatctgaaaatagccactgtaccccagcctgggcaacacagcaagaccctgtctcttaagataaaagcaaacaaacaaaaaacaaccaatgttgaggttacacattcccatcaacagcaaagcagataaatattactatttatttggttgtgttctatttacacaatgaaatactatacaacaatgagaacgcacagtctacaaccacatccatacatgagggatctgatgatgggaatagtgttaaaagaaagaaaacagacacagaagagagtatggtgtgtgattccctttatatgaaacgcaacaggtagaccagtccccggtattagacatcagcatgatgtttgccctgggcgaggcagtgactggaagggtatgtgaggaaggcttcggggaggtgataatgtttattgttgttggctgtgttggttttggggaaacattcagtttgggaagagtcattaagctgtgcacttgtgataagagtgctcccataaaaggttttataagatttgggggctggaaagatatatctgtcagtgagatttctcgccatcccagttccctgtccctgctttccttggcttgcgcccttgccctcttggcttgtcgcatctccctgtgaccttcccatgggcattcctcatggtgagaagtagtgtggcagagtggggaaagacttggaagaggtgccacaacacctggctttgatgccaggttttaccacatgtgaagctcgaggcaggcctcatgccatctgttaagctccagtttcctagcctggtcctgaaaagcgggcttagtctgtcctctctctatacgtgcttgggtgcccttcctctcacctcggtcctctaggtagctttattgcaccatagaatagagacgtggggactgtgagcttgtggcatcaggcagacctgtgcataacaaagccttgggcagtgattctagatttctctattctctaagggaggctgactattatataaagtcatagcaggcccagcgtcccttattcaaatctccaaacaaatgagacaattaacttggggaagtctcctaagccagagcttcccggacaaaacaagactatgattaacaagtgacaaggatagacatcttacaaacatgaagctggcattctcaaaactttgggggaaatgtgtgctcttgaaaaactcattggtaccttccatattataaatctgtttaaagtgtgcttgatagaatttgttttttttaaagaacagttgaaagtgaggggaaaaaaaaaagcttggtccctgaaacccaatgggttaattctcccctgtggcagaggaaatgccaagcagcctttggcagcgttcttccttctttgtataacaacactttcaagagctagagctgggatcatccagtaatgcttttaatttgtgtgtggttgcgaagaggccaggatttaatcgaaattgttagaatggctttgcttggagtagctgagtgcttgcagtagggctaggaggcaaggtagcgctggaataattaaaagaaatacctaaggcatcatcattgcctgagttattccagataccaggctgcagagtaaaaatagtgaaataaaatttgtgcacagttacttttctattatacctcaattttctctcttcccattcacctaataaaaggagctaggtctccatgtttgcttaacggggtggaggctaagccctgggaactggctgtttctcagccagcccaggtgctccaagttcctatttttatcctgctctgtactgtgggtggtctgaactggcttaccctcctgaattacatgtagtacacagctgtgctgagaacatttttcttgtcgtaccttccctaggtaatgggacagcaagagctccaaatcttaccctcctgagtgtcatccttaaacaacatgtgaaaaaaaaaatagtcacaggaattggggtttccatacttgtcctcatttctatcctctttctaaagagaacctgtgcccccaagtccccagacaacatatggtcaagattaggaatcatgtccccaaaagactaaataattcaagaaaaaactgagcacatctgtgaagcagagatattcacctgacttatttatatgttataaacacttaagtgtaccacaggggaccaagcatatgccaggcaagtcagtcactcaatcaacaagggttcatttacctctacaaaccattcagtttttcttttccccaatactgcaaggccctgtgctaagttctaaggtaaagaagagagaaagaggtgagccttctattctgaagccctgctaaaaagtgaggtatcacacgtggaaaggtttgaggtagatgtttattcaatgtgtttgggccaatagggcacttctttcgccgtgtggcaatgtgtttcagcacctctggcatcaagggtgaaggccttagcagttacccacagtgaaacaacctttgcaaaaattgtaacagtgagaaaattatgaccgtgaaagagacccgatccaaccaatccccatcttgcttttaatctccaaactgcctttggtcattccagggcttgggccaggctaactttgggagaaatttgattcatagttttttatttatttatttattttgagatggagtctcactcttgttgccgaggctggagcgcaatggtgccatcttggctcactgcaacctccgcctcccaggttcaagcgattatcctgcctcagcctcccaagtagctgggattacaggcatgtgccaccatgcccggtggctaatttttgtacttttagtagagatggggtttctctacgttggtcaggctggggcctccaggagtcagggtggttctaggggacaccatgcacttgtgagtggacagaccaccagccggaaaacaaaacaaaacaaaacaaaacaaacaaaacaaaaaaactgaagaagcagtgaggatggacccccggtctccgagtgtgagtgcagcaggcctaagcagccatggggataagtgggcacagtgtgtcccctgaacagcccactgtcctggagggagcactgtcacagagtcattggtcttatttagcctggcccagaggatgaccaaatgtgcagcactctggctggaacctggtgtcacaattctttcatctgttcccactccctacctcttgccctcgccatttctctctcttacctcagaaaagctggaaaccagcccttctgcttccagaacgatcttttagtatctgttctgctgtgctatgaattacattctcagtgcctagtccccatttctcccaggtacttctggcaaactcatttcctaaatgccattttcgttttggtcattccctttgcaaaatctcccgtggctccttcatgcttacaggtggagagatgaactcccttgcctggtattcaaggatctctaccatctggctctacctggttaacctcatcaaattctggaaagacacatctatccgacctcagtgatctggattccttggcatctctaggcactgcatgctcattttctcttttcaacttttgtttatattgcctcattatcttgaattcctctttgctcttattttctatccatatcccatacatgtgccaaattccaggacggatttctgtaataggagagaatagaagaaaggtgtattcataaattgtcctagggcaaatcttgaattaatttagatagagagattattaaataaaatcaagtaataatataatattaaaatacaactaaactatttcatcacatcgtacatctaaataaattccaggtatattaaaatattatattttacaataaaaacacaaaagttgcaaataaaatatagataaaacttttttatatcttattttatttagagacagggtcttgctctgtcacccacgctgtggcatgatcatagctcgctgcagcctccaactcctaggctcaaacaatcccccacctcaggtgtgtaccaccaggcctggctatttttgttagttagtttttgtagagacagtctcactgtgttgcccaggctggcttttaactcctggcctcaagcaatcctcccactttggcctcccaaagtgctgggattacagatgtgtgggtcaccatccccagcccataaatgttttggaagtccctaaaaagaaatagaatttctaaaacccagcactttgggaggctgaggtggatgcatcacctgcagtcaggagttcgagaccagcctagccaacatggtgaaaccccgtctctactaaaaatataaaaattagctgggcatggtggcacgtgcctgtaatcccagctactcgggaggctgaggcaggagaattgcttgaacctaggaggcagaggttgcagtgagctgagatcgcgacattgcactccagcctgggcgacaagagcgaaactccgtctcaaaaaacaacaaaaagaatttctgaaagaaagaaagaaagagaaagaaaaagattagcagagtgacaatagataagcaaagtcaagtggaaaactgcaaattgggtaactgttcacactaaacaaggcaagtatctcatcttttgtagatacccataagaaaacattaaagtgtaattaaaaactgaacagagaacattaacaaacattctactgcagataaaatataattagacaaaggaaaataatgcaagttaaagcagtagattcttttttatacataccagattggcaaagtaaaataataatagtgataacaacaataatttatggcaaaagtgcactgacgtggataaagcacatattatcggtgagtaaaacatctgagaaatcaactcgacatttttcaagaacctgaaaaatgattacacaattttatgataagtccatctatggataggtattctaaactatgtttatactagtgaatatttgaaaacagactaactctctcacaaaaggagaatgattaaataaatatatgtaagaggcaaaatttgattcagttattagcatactagtctctaggaatttttgatagcaggaaaattagtccagatttaatataagacaaaaaatggaatagaaacatctatgtaaaaacaaacaaaaagaaatgtctacatagctcattatctcaaatacgcaaaaatagacatgcacacatgtgcatgcacacacacactcaaataatatatactaaaaggaaatccaccaaaatgaattattagctattctgtgtgtagaatcatgagctattttcattttattatttataattttttttgcaaattttacatcagaaatctctattactttagaatcagaggtaaatgaaatgaatactttaaaatttccaattaatttcagccacaaagatgtcagcattctttaaagtcctgtatcgcatacatcctctgtacatcttccatctatgcaagtgtttattctgccagttcttcaatatccactagtctttcttctccatactaaacagtagtttattgtaagtattggaaggaagagatcatgtcaggggtccagttcactaatctttccaaggccccattcccttcagggaatattgatggagaactgatagggctgtttaacaattaagtgacacaattaatataaagtactgttgacaatgcctggcacatagcaagcactcaggtgaagaccaaggcgttagggtcaggttgacatgggttcaagcctggactctgagatttattagtgacaagattttgaaaaagctccttggcctcgctgagccacacttttattgttaagtgagaatcacagcagctattgttagcaagctgctgtgatgtggcatgtcaggtgcttttagcctagtgattggctgcaggaagcacttgatgaacagctgctgcggtgattcctcccaggagcagtggtgatagtagcagtacttccagtagtgatttttcttcccctgctttccttgtcactccattttagtggtaaactttttgagtgctgaggttctttgttagatctcatgctctgtccctttctcagacgggcattcagtctggcatctttcatttaggggatgaaacatgacaaattatttctcagtagccgagacgaaccagctttttgttggtaattcaggggcttctgagggaacagctagtgggtgtgtggtttccatgagtcctctgaattcgatgagagtggccaatgtgtggcagcaatgagtcaagacacctgtgcacctagcgtagagaacaggtattttgctggatttgattgaagatattcttccatggcaccttatgtttatattttctatatcgattattaatgaaagataaagatctgttgacttgtctgcattccatgatagactgtaagcttcaggagggaaaggatcatgtttctttttttactcatccaacaaatgttttggttgaacatttctctctctctctctctctctctccccacctgtctgtctctatctctgtctctctatctctcactccatctctatgtatgtatgtatgtatgtatctatctatctatctatctacgtctatttctctctctctacctacctatctctatctatgccagacactttgcaagttgttgaatattcagtggtgtacaaaataatcatgactttgcattcacaaactctagtggagaagagggctatttcataaataaatacacaaataagaatataattacaactggtgatgattcttttttatgaaggacaagaacatgagctccatgagagagaatagaattgtggtggtgagagattgacctaatttagacagagggggtcagggaaggcctgttggaagatgtggtacttgagattgaggatgagtagttctgtctagaagggagtggcttattcagtgctgcatctttggttactaccaatagcactattcaagaggatacaaccctaggtcccttaagaaaaaaaatttttttaagtgactctttgggtagaaagtcagagaatgagctggggaaaaagcacactggcccaagaaagagaaaacttggcaagtctgcctgaagactgaaggagacatgggaagaagaaagaagtgtttaagacatagactgagtccctgggaagcactacaagtcaggaactgctcatggtggcttgtttttgaaaacagaccccacacaaagctctgctgattgatggtttgtttcagaatggtgacacatccagaaaacaacacagacacaatatttcaaagtagaaaagaaaaatatgtctgatatccagaaataattaccaaccaattgaaatctattctacagttgcccccaaatgccaatggaaacaacattacatgactcacaaattcttttctgtccgctgtcttagccagcttgggctgccataacaaaatactatagactgagtggcttatacaacagaaattaattttctcacaattctggaggctagaagtccaagatcaaggttcttgctgattcatttcctgctgaggcctctcttcctggctttcagacagctaccttcttgctatgttctcatatgattttcccttggtttgtatgcaaggaaagggagggagagagtgagaaagtgagttctctggagtctcttcttataaggacactaatcttatggaattagggcctctctcttatgactccatttaaccttaattacttcattagtgggtctgtctttacatacaaccatataaaggcttcagcatataaattttggaaggggtacaagcattcactccttaggatctatttatgttctgaaggtcccactaatcactgcaaagtagctgggtccagtaaacatgttttctgcctcttcatgtctctccttttctcaaaactcaaaatgacctcaagtcttcccacatctcaaaccccatctagccttaatcctgtgacccgtgatctgttccactctttctaatgtaggtgtagctggcttctctagacttctccttcagttctcctttctgcctattgatcatcataaacatcaaaaagccaggtgtggtggttgcctatgtcacaaagggcattctccttcagcaagcaggactggggagtggctcaggatgactcacattttagtatttttctttccatgctcttggtttgccatgccccctttgtctccacatcacttgtcttacttgcccctgatagtatttgagtggcacagacaaaaagggaactgccaccaccatcaggtctcaagagcacatttagcacctgcagagctccgtatgtgcaaaccaatggcccagcactgacatttttggctcccgctaattagctatttccccttccaggatgggtactgccctctgttttgcccaaagtaaatgaattaagttgtttccatacttgaggccaacccttttgtcagcagcagcaacttaattactctccccctatgaggcagagctggagctggttcaagtgttccaccaatggccagcaggagaaaaaaaaaatcattagaaaatcaattcttatttaattgaagatttttcctccgaatggaaataaagtgggatttatcactgcagtagcctcacagcctgggtaatgactgcacttttgcctttctgggtttcccttggtagataagatgtcttcagcacccaggctcagcagcaccacacacgctgacttctgagggtctgagagagctaaggaaagcaacagcctggatgatgaatccactcaggatgtgggccaaagctgtacaaccaaaagatgatgagaaacaatgcttagaagtaagatcaatacaggagactagaacccgttggtctctcttcttgcaagaaatttaaaatagcatattttttagggctgcttatttctcttaaggatctgctattgcctatagcattgagactcccaggaagtgctgagtcatggtccccagcatttgctgggacaaatatgaattccatctagttatgggcaccacactggtactttgacactccaggaatggtgaccagaatgatgactcacccagaaactacagcattggagggagaattgaaagcattgagagctttttgttttgagaaatgaaagttcagagatgtgagaggtgtcttcaaacctgtgaatggcatagccttgctttgagttgctgaaatgggtagaactagggtactcctcacagggaggtggaccatgatgtatttaatgcaggagctgttaacagaactgcttagaaaagcttaggattgtgtttagggaagctggatttgaggaagttaatatttcaaggccacaaattcctccattattcccctcaaacaagtgtctatctatttgtctatcatctatctatctatctatctatctatctatctatctatctatctatcttctatcatctatctatctacctattgatctatcatcttatctatcatctatctatctcaactgaatggcaaaccccaattcaacaagccctctatcaaaagatcccctgagaaattgttagcatagtatttggagaaattagaccatgctaatatctattttaaaacttcagttgctcctgttttctgtaaggtgaaactgagaccattggaaggagctgcaatgtctgtttttcacaatgcaaccctagtctactcctctggtttatgtcctttccttctctctcctataagacctctttatgatgcggacacagtgatattatagtccttacccaagaatgctatgcctttttccatcagcttacctttgcccattgagaaggctgcctggaaaccctttctcccgtttgctttgggaaatacctattcttcgagacccaaattttgtgggtcttgcctctctgcaccaagaacaactcatgccagcattttaacagtcttcattattttatgctgcaaatttgtgtttgtgtgtctgtctctcccactagagtaagatcacattcaaggataataatcctgtcttattattttggaaaaattgtctctacaagacctgtttgaaggtatcagattgattatcacgtgttcatgcccagaaatacatgaatagaaattagtttgtaccatgagtcacacacttggaaataaaatacaagatagttaaatatcaagtagaaaagtgaaaagaactttaaatttgtccaaaggatatcaaatataattgccatggtagatcaagagctgtgaaagagccctggatgtcttataaagactgggaggtgaggataacaaataatagctaccacttaattaagaaaagcatgatgatagctacccaagtaagtgattttgcagatattgcctagttcaatgcttacaacaacacaatgaagtaagaactaatatctctgtttatgaagtaaaagatgaagactcacagagtcaacttttaatgccacacaacaattagggtgttggtacttggctttaaactcatatcagacatgaaatgccattttcttcagcactacgcaataatgtctccctagataaatcaagatggcttcagaaacatgccccttggatggacctttgtattagttatcaattgttgtgtaatgaattacatcatagcatagtgtcttaaaataagagatatttattatctcacaatttctatttggaagctatctgagtgcagcttaattgagagcctctgcctcaaggtctcttatgaggttgcagtcatgccaggtcttgggctgtggtctcatctcaagtcttgactgggcagaatccactcctgagctctctcacacgaccagtggcagatttcagctcctccccagctgttggccacagacatcagttctttgtcacatggacctaatctcagacacgacatcccatcacttctatttgctagaagcgagtcttgaggttcaattatactcaaagtgggggactgcacaaggacaggaatcacgggaggcagagaatgtgcatgctattttagagactgcttcccatccctgaaccacttgctgtgctctggaacaaatggcagaatgttcaggggaggggatgggaaagtgaggctgtcatcagcctctgaggacctgaagggcatgagctgcccacagtctgaggaagatttctcttatttactagcaacatttgtaaagcctccacatcacgaggactctcaaaagctgacaaggtggagatgctcaacctcattttcaagtgttcaaactcaggcttagagatgctgaggtacatgattctgctatcaaacacagaaggaactctcagatgaaatgctgcctggaggtgtgatgacagtcaaagagagaagaatgtgatactgtgatataacaagaaatatctatttggtctctacctccagttgctgagacaaagctgctaaaacccttgtggatataggtgctaggagaatcttgtcttctaatgtttggtctttgacaccagtttctaaaacagagctcctaaggcctttgtaatttcctgagttgtaggaacatctgatacagagctcctaagttccttgggtgacagaagcatcttttgttctaatggggtgacttttcttgggttcctggatagctcaggatggggttggttgccaggggaaccaatcatgtgattagagcattgaaactttcaggctcactcctgacctctggaaaggatagaggggctaaaatttgagttgatcatcaatggtcagtgatgtaattaatcacgcctacatagtgaagcttccataggaaccccaaaagacagggttcagagagctcccaaattgctgagcatgtggaagtccctggagagtggcatgcctagggagggcatggaagctccacatcccttctcccaggcttcaccctatacaccttttccacctggctgttcacctgcatcctttgtaatagcctttataatacatgaatcaacaaagtaaaatgtttccttgagttctctgagccactctaacaaattaattgaacccaaaaaggggttatgggaatgcccaattttttggttggtcagaagcaaaggccataacctgtggctagagagactagcatgtgaagtgagggcagtcttggagactgaggtctcaatctgtgagatctgatgctatctccaggtagacagtgcccaaattgaatttaactgtggggaacccagctagtgtctctcagagaactgtgtggtgtgtagggaaatatctacacacattttgttgacaaggggtgaagtgttctgtgctgcattgagtgtgtgagagtaggaaaaagtttgttttttcctattacttacactttgtttttttcctatctcaaacaaggaagaaggacagagggttcctatgctgggggaaggtagtgtatgaccatgcctgacctcccagcttcttccgctgtgctgtattcctcacttggcatgtatctgcaagttgtttggagtgacctttctcaagatttgtgtgcatcaagaccggggtctttacagtatttcaacatttggattctctctattttcgttacaagaagcaaagccccacctgcgacacactggcctcaactttgttagataatcaatagtacactaatgcaatggattagaaatatgtggcaaaggactggtgcacaaactttttgttaatgaagcatgactgactttgtggctacctgaaaatgtccttgggccagctttctcccacgtccatattttcatattgggttcccctataagtggtcattttagacctctgttagccctcccgctagaaaataaccattgttgtcagttctgggtctagagtgttcccaagtctgttcactttctaaccagttggtctgaaatatttagtttgaaataagaaggggaataatgtatcattgggataaatcaggtatgggagaacttatcaaagttcaataaacataaaagtgatgaattttgaagtcacacaattaactcaggattacatgtgcaataactgagtaattacacctttaataatgcattgaacttgtcaagaatacttactcattctgctcaaattttttttaacaagatagcctatagcaagtgactgtaattagatattgcctctgaaaacatcgacagctcctaattgataccttttattataaagctagatgccaaacatttgctgttgagttgattaaggaataatattagatgtgttgagatcataatacctacttgcagaaatctcatgtaagtagaaaaaaaaaatccagttcgacccatcaatcacccaggtaaagttggttcaagtttgcactggtttgctttaaattacagcctgacagcgattgctattgccagggctgtcaggaaaagaaactaggggcagaagcaggtgggaatggagatggggtcccaaactgcttccttttttccacgtggatggtcaggagagatggcactgggagatcgcagatggcaaaatgtctccatgtggcgaggggaaggagagactatatttgctcttgtcttttgacgaaagattatttttttccacatcaaggttgatattaaggacttttttttgttgttcttttgtattttctcaacagctgtttgagacagggctctaacattcataaagataaaagagagaagctgtggtttaggagtgtcggggagtttccccagcctcagccccatctccagggtttcttctctgtatagtttcctctaaatccagagttcctattacagggaagccttgggaacattttagaaggaggcagatgttttcataggcattagggagcaggtgaacaacctccagatagcaatcacctcacggcccatgagaggcaggtttcaggtagtgaagagcttgagctctgccctgtttggatccttctcttccagggttacctaccatgggatctgaagcaggtaagttgagttgatcaccaatggccaatgtctttatctgtaaaattatccttacagtccagaccctgctgatgcagtgccagggcatgggtacagatagtgaccctcataccaatgactacatatttaaaagctatatatcaagccagcaaactgtggaatcaaacattttctatcctcctactttgacagaaacaccttcaaaaagaaaatgtgtaggccgggcacagtggctcacgtctgaaatcccaacactttgggaggccgaggcagttggatcatgaggttaggagattgagaccatcctggcaaacatggtgaaaccctgtctctactaaaaaaaagaaaaaaaaaaaaaaaatagcagagcagggtggtgggcgcctgtagtcgcagctatttaggaggctgaggcaggagaccctcttgaacccggaaggcggaggttgcagtgagccgagatcccgccactgtactccagcctggtgacagagcaagactccgtctcaaaaaaaaaaaaaaaaaaaaaaaaagaagaaaaagaaagacagaaaatgggtaaagctatgatacttatatgactgaaagacatccaaatataaaaggtggccaaatgtaattgttactgcatggttctggatgtgctattagtaaacagagatactgggttagtcataaaataaagatgcatattatttacaaattattttgtatttattccataaaaattatttattcctttgagttctcagcaaaatcactatgttactataatcaagattttcacagaattttgttctattggcaataatgacctgaacaattataacataaaatgtgatttattcaaaatgtgtatatattttatatatttatattttacatccataaaaatgcaaactaagtcaacgttggaaatgttaaaataattttaaaatgtaaatgtaaaaactaaaacatatattttaagtgttctcagaaaagtcagtattctacaatattgaaaaatactaaaagcaaaaggaaaaatcgattacttaaataggcaacacaaaatggaaagtgtcatttaataacattaaataaaatgacattttaatgtatttatgatttaattaagattttgtagaaaaattcaaacaaagccacaactctaggattcaatattcatctagttgtcggtgtaaaaatgtggtatcatgcttcatgcatgttatgtctagactcacatatattcaaatttcaaagttctatgaattgcttaacattgcaaaatattccatggctgttctgaggggctgttgtgaatgctggactgatttgtgaataactcgagactcaacattggaacacaaaaagaagcaagaaaatggttgcaggaaatgagacttcgttacagaagaatcttttgcattcatgcagagaggaaagatttgacaagctaacagatttctcttttgtctcctctcaaatcctcctcaatcccagagcagtgtccatttctgaagacagcagcacaactcacagacctcatgacatttaaatacagtctcctttggtttcaaggtcacccactgggcaagaggggtgacgagtatttccctgggattttaatcttgttagtcgtaggggtggctttgtaggacactggctcccgcgtaacaaagacattgtgaggtatataactttttttaaaaaactttattttagaacagcttcaggtttacagaattacgaagatatactttttgaagatacaaaagtgctatatgtttccatacacccattttccccttttattagcatcttacattagtatgacacatttattagaaagaacccatattgttattattaactgaagtccatattttactcagattttcttcgttttccccaaatatcctatgtcaattccaggatcctatccagaataccacatggaatttagttgtcaggtctccttagaatcctcttggatgtgacagtttctcagacttgttttgtttttgatggcctagacagttttagattactggctaggtattttgcagaatgtccttcaattgggatttgtctaatgtttttctcataattagctattggtttttcggaggaagaccacagatggcattcgcatcacatcatatcatcaaaagacgtgtcactcttgatattgaccttgatcacctggctgagttagtatttgtcaagttacctcactgtaaagttatgtgttttttcttcctttccacatcattctctttggaagggagtcactatctacagcccacgcttaaagactgaggagttttcctctaccgccttaaaggcacagtatctacatacattatttgtagttcttctgcatgggaaatttgtctctttctttccacttatttattaaataattcatttatatcagtatggactcatgaatatttattttatactttagattataatccaatatgactttgaaacattctattgctcaagttgttttagctttggccactgtgagtcctttcagctgggtcctgtgtcccttagacatacccccataattgtgttgtttttcttttaatctcgtttgaggactgtcttacttttcagcactacatgatgctacaggcttatctcatgtattttttttttttttttttgctcctgtcctagaatcagccatttttccaaggagccccaccatgaggtttcaataaatatattgttacctgtatgctcacaaaatgcaagttccaggcccaggagatggacctctcttttccaggtccaagagtaatgcaggttacactctttacatcatggagttgaaggaacagttaaaagagttcacgtgaacaaagtgcttggaatagttcctggcacatagtaaaagcccaataaatgttgactatgattatagctgcgtgcaatagaaactttctcatgtctcaccagtgaatgctgcctgttagcagcaaccatggcagtagaagtaggagccaatatttgagttatactctaccatgcagaaccatccagagattactcacatccagagatgatttctatggtttattctctggagcaaatctttttagttattgacccatatgggtttccctgtaagtaaagacaagtcatctgttacctatctcacctgggatgagttgcccagtggcaactcaggatgagaaggatgttctcatcctgctatgaagaaatatccaagactgggtaatttataaagaaaagaggtttaattgacccacagttccgcatagctgaggagacctcagggaacttacaatcatggcagaaggcacctcttcacagagtagcgggagagagaaatgagtgcccagcgaagggggaagcccagtataaaaccatcagatctggtgagaactcactatcactagaacagtatggaggaaacaacccctgtggttcagttatctccacatggttttgcccttgacacacagagattattacagttcaaggtaagatttgggtgcggacacagagccaaacctcatcagccagtgtcttttatttgaactcttttttttatatgtaaatgtcttatgtagtgtcatattctacttgcactttcttgttttccttgcctctactctgtacactctagtcttttggtggcttgatgctgaagtggctcccttacctctgctcaacctgatttctggctctaagaactccccctctctaggaaggggaaaactttctgttggaagttgaggcaaaacactccaggaggggacagctccctggggctgtacagagtgaccatgtatccaaggcttgctggagccagttgaagtcctacctcggtacttttacatttaacatcttactgcttaagtatcatttaccaaaaaaaaaaaacatatatatatatatatatgccactgttggaatgtaaatattttggaggaatttcagtcagttgggtaaataagataaatgcatgaaactataataaagcattctacagtagctgtcacattactgttgaggaggagaagttctgtaggagattggtaaggagaaaaaaaaggagaaagacgttacacatttcctgggtagagctacagagctgctaagggtgtggacgctggaaccagatggtctgggctcaaatactagctctgccacttgtaagtcatgtgaccttagacaagtcatttaacctctttttgcttcacttccctcatttggggatattttatacctccttcagaggtttgttttgaggataaaatgagtcaatatgcacaaagcacagagaatagggattggcacatattcagagctatgtaaagtttatgctatttttactaggtgtcacatgcaccatgcaagggacttcatgggatatttcattttgccttttatgcaaccctgacagggctacttgacctaacttttaaagacaaactcagagaaagagaggctgaggatcaaggatgcttatgtattggtaggagtgaacttggcatatacgaagccaaggagtcccatttaggtagggagaaggatagtattaggtagctaggaacagttcctagaacctgctgaggtttggtggttacactctgtacatcatggagttgaagggacagttaaaaaagtttgagagtaaacatagatcccaaataatgggatgcagtgactagattgcctggggctgcaatccacctcttccacctactgtgtgaccttgggcatacggcttaagtactttggaacctcaatttcctcatctgtaaaatggagataaccagttctacctcctggggatagtatgtgtttatacgcacttatctgtagaaagtatttatctttatacatgtaaaaccatttttacatgtatatcttttttacatgtaagtggcatttatctatttattccatgttttttctattctgtggttctgttatttttagcatccaacgtcaatataatagcaggtctttagaggccaaggaaatactgccactttcaatgtaaatgttaaatataaaatgaatccttgttacagaaaggataaaatataaaatgaacatctgtctcagaagagagaaatggagcagtagaatctcattaagcatctccccctctctcctccacctcttctgctaaactctccttctaaatgacagacccacttcttgggacttaacccacagccctgggcttccccaaactctgcctgtggtgacgcccaaggcaaggcctgaaggagcgtgtggagctaagaagtggacttgtagctcaaaggaggtagaaattgcagtagggggtatacaaattcttcagctttaaagaacttcagagttagacatcattaaatcattaaaagggcacctaaggggagttaatatgcagaaaagtagagctaatttgagctctcaagtgactaactcagaattgcccacttaaactctgaaccctttaattcatatgagtacattatagattccaaagaagacttttttcccctccttcaaactttggccttccctataggcagggcagagggtgggggtagctttcgtagagtggagctcaccacccagaaactctgcggtataaatatgcaggcaagggtttttgttttttttttttttttttttttttttttttttttttttttttggctgagagtaacaattaatagctactgcctggagctcctcactaaggcacagattttagtagacttcaatcctgccaggacatcctgagataagattagatcagtggttttcaacagaggatgattttatccccctgcgccactccaggagacatttggtaaagtttgaagacagttttagttgtcttggcttgggaggcaacagtgctactggcatctggtaggtggagtcctagaatgcacaagacaatccccaaaagaggattatctagcctcaaatgtccatagtactgggactgagaaaccctgggtaagaccagcagaaggtattaggttggtgcgaaagaaactgcagttttcgcaattactttcaatggcaaaaaccacgataacttttgcacgaacctaccaacctaataatttctcatcaggccactcttcctgaatgcagagagctactgacatcctccgcgccctctgcttccaatttctagctctgacaaatgtggataaatatatctggattttgaactcagaatatcttgccttgaaattcagtcactttatatttctaagcctcagttttctcatctgtaaaatggggattacaacagtcatctttgggttgttgtatagaatttagtctttatgcagtaagcactcaatacatgctaactgttattactgtcccaggattgaagcatccttgtttaggaaaacttcacttcccaaagggacataaaacttcttccaggtcatgaacttctgaatcctaggctccttttgccattgctgatcctgccacttttcctcaggcctcattttcttccaaatgcaattgttgcaatagggctagatggccaacttcccccattttaatcagaatctctgccagaatgaactattgaaagtgacagtctaaacgggttattctcatgccaagtcttgccacagcgcccactgcctacaaaataaaatttgtttcttatcatgccctcaaggtctaactcttaccctaaactcttaatatttgctgggctccaccttcaactattctcaccatatgctgtttctctaatatattggtccatgtcttccttctaagcttctgtttttgacattgcctctctctcttgagtgcccaccccttcttaagttgtcctatcaaatatttatttcccaagattcaggcgaagacacagctaggaaactatcactaaagcccaaggggggtctaggcttcatttacttgcatacccacggcacagagggcatgctttagttcaccaaattccttgcagtgttggacttttgggaaattgtctgtttcactcattgtttgtttcagaaacatactctcctggaaataaaacattggtatcagacttttctatccctctaattttgtcaggagtccgttacagctacaaaacttcctaaatctccagctttattttcctggggttaagaaataaaaccccactctgttccttcttagctctatgaccctgagtgagctatttaacctctcttagcttgttttctttttttaaatctgtaaaattggactaatagtctcattggtatctttgtgcatattaaatgagaaatttacataaagtactcagcacaatgcctggcactagtgctcactgacaactatttttcaaatggtagtcccttcagccttgaagggagaaaacagagagtttgaagaggtgagcagtagaccaggcatgtccatggggtacaattattcacttggaagataaaggaaatcaggaggtggagatgagactctttaaaaaaaaaaaaaaaacaattttgctatggttgagtcatgccaggctggactgccattgcctgggctggttctagagcatgtacacgtgtgtgtgctcatgtatgcctgtgtgcaggcatgtgcgtgcatgaatgagagatgaggggctcagtattgagcaacacagtttaggtttagaaacaggattcagccatgggcttctgctctgaccattgggaaaagatctgaacccttcaaagccaggataagggtctctaaagtaagaaggtgaacaataaaaccctggaagacccaaaagcagttgagaagcattacagcccttttgttgcaagccccaggaaacaggggaaaaataaacctggtctgacttcaccactcctgaaccataaaatgtttacctcgggggagggtagggacccaaaggaaggaaggttttctgttgtcaagctctcttctaaggatgtatcctgacccttgtcctcaggtctcctgggcctgaacaccccagggcctggagaatgctaatgcagtgaagggcttagccattcagcttctgggctgaggtcagcttctgctcagcactgagtcctggggagccttccttcctctttctgttctcgaggtctccatcactgtagggaggccatgactctgtcattctgtggatctgattctgggtgattccatgttgccccacagggtctgggtcagaacctacaccatgctagccttgtcaaggcagggcctctcttccctggggctgtgtctctggcttcctgcacttcctgttctctaagagagccacacaaagcccaatgttaccaccagctcctgcctcatcactctgcttgtctcctgtgaacttgttcctggtttgtttcagaaatgcgtcgatttaatgtactgcttaaacttacagatattggggtcagatgtgcagagttcctagtgggatgtccttggcagaaaatttagcttttcaaaagtttagtatcttcagctatcaggagggaatgatgacagcctttcccttataaagcggatgttgtaattagaggtgagaatgcaggtgaagtactgaactcggtacgtggcccgctgcaactacttggaatgaattgttaaatgacagtgtctgggtttagcccttttcagaattgctgtcactttacacttgaatgccagttcacctctcggggtgtggactaagctggaagtggttctgggcagcaggaagcctgttatagctctatacggcatgattctctcggctttaaggagatgggacttccctaacccctccatgtccatgtggtcattctgccagcttccagagaacatttatctgagtcccttgaagtcccagggagcaggtcatgcagcaggacgagaagactgtggctgaggacctgggacaggccctgtttctggcaccatgtctgtgttccacatctgaatgaggctgctggggatgctagaacagcaatctggaaagcagggagggttgggggcatcatacacaatggaactgggatggaaagcaggcctgggccacacacaggcttagagagtagaatggcctgtgagtctcagagattcaagtaacaggtgggccagttgggtcagtttggatccttgaagaaacagacatgaagaagagactagatacctaagagatttactatggtttgggggtagggtagggaacatttctacaatataagaggggagaaagtgaaatttggtggggaaaggcttcagaccatgatgcaggtaacacaccctaaggaaggacagaggaagagaaggattgggcaggagaaagttcacactgtggcacagttctgacaaagttctggccggcccatggcaaagttgcttatgagagggatcctgagtagggcaggaatagccctattctgatactctctgatgtgctcggtcttggctgggatcagtcaggggaactttggcctgacaataattgaagcgcggattcaaaggtgtggcagctggggctgtcaaccactcatgctttcctcagcgggttcctctgggggagatcggagcagagcagctccatggctgccataacagctgaaatgatttctttttagaagcttcaatcatgaaattgtctgtgataaggctgatggtctcactttccaactgacacacacacacacacatttactcactatgcatacatgagtatacagacaagcataaacaatacacatgcagatgcagatacatatagtgtgtcatgacataaatactgaacaagattcgagtctaaagtctggtatgaacaagatgcatagccttgaaaaaatcccttttattgaatttatttttcttaccaactatataattagaggcagcactcagacctcatttgactctatcattttatgagtttatggattacagtactcttacaaccagtatcagtacaaacagacattgtcaatggaaagttccagccaggcagagaacaaagggcacactcattcctttaatgtacattcatgggcacttcgggtaggttggtgaacaaactgcatggttcttgcccttctagaccagtattcaatgggaatacaaagagaaagaagaaatgaagtaaacaatggtgggcatttgtagaggataagcaagattcagtatcagagaactgtcgagagggggaactcttgagagatttcacacaatgttcatttgttcaacgtgaagggcaatttatccattccacacatatttatgggtcatttgctgtgtgccaggcatggtgctctctgttaggttaagtgagttctcagtcaaaaccatggacaaaggcgtccttttggacatcttcccagacctgcttggctctttgttaaaatggtacttgtcacaaacttgttggtgcaactcctgttaacaaaagcattccacagctcacgttctttgtgttttatttcctactgtgaaaacggcaatattaagcaagcaaatgaaaggtctttggcatagagtcagaggactgttgctttcttccagttctgccacatattagctctgtgctccagctgaccatgctgtctttctggttctcagtttacctgttgttaaggtggggatggaatgacatcttccatctcatccagttcccaggttactgcataaaaatattgtttttttctgtggaattccaacaagtctttctgttttatcaattcataagtgtatgttttaattaaaaaatattcttcaaagcaacaaagaagcaaaagagcaattatactgaatcccaaccaattcctcccagaaaatttattattattatgctgtattttattttttgagacagggtctcactctctcactctgttgctcaggctacagtacagtggcacaatcacagctcactacagcctcaatctcctagtctcaagtggtcctcctcacacccaactaatggttttattttttgtagggaagaggtctcactatgtgtcccagactggtcttgaacttctgagttcaagcaatcctctcgcctcagcctttcaaagtactgggattacaggcatgggccaccatggctagcaggaaattatttttaaacaaaatttacatttggctcccaattataccactttctagctatatggccttggacactttacctatttatttagagcctcagtttctccattgggaaaagagtttccaggtagatcctccttctgtgcttcagtgttttggcttagaggtagaggtgttttggcgtgttttgtaaatccaaggagaggctctgactagagccagcaagcccagctatttctagattctgatagaatgggtttcctccttgggcatctctctcgctttcacactttaagaccctgaggttgcagggaaaatagggtgacttttgttaaagagctgcaactcggcagttgtgttggaggtcatggtgcttcgtcagaggcagcagtaatgtgtttatttatcactgcctactgaccatatgtcccctttcccttcagtttgttctgcccaaggccgttggggtccgacagagatcaacagtgtttctaccgagatgcagcagctcgtcaaaacctgaattagatgttaaatctttttgaattggggaggaggtgaagggagggaggaatcatattgtgctaagaatttatcctgtgttgtttcctgtgagataatgtccctggaaagatttgttaccaagcaagttgcaaactgctgtttcaggctgataggtgttgccaattcattttgatgaattctgccagtcagaagagtatttttcccttctttcatttgctgaggttggctggagatggacaacggttttaagagctgagatggcacacactggcatgcccagggtatgtggaatcaaagatgctttgagaaatacttggtgctgcacagaaaagtaaattatcaggctaaaaatggtctatcctctgctctcagctcccaacccatgttctcagctgctgcttttcctagttacttactattgctccattgatcctcccctcccagactccatccctgtaccctgctagcttccaaacaaccctaatatccccattcccgctaggtggggaagaggtacaaccaagtagactctggagtcagactgaaccaggcagaagttcagtaccctctctaatgggctgacctggacaaattacatttctgtgaccaccaatttcttcatctgtaaactggaggtaaacataggctgggtctccctcactatttgaacttgcactatctgcaggcttgctatccaaacacaagcgctgaatagattcagatatatatttaaacaaattccttgctctccgaacttttgctcctcactctctaaaactcaggaacaaaacaggggtgctcctttttatcctcacttgctctccaaacagatacagattttgaagcacacttgtactggtttataaaatttagtgtgaaataatgtcattaaagtagttcgtacagtaccagttaataatgagtgctcaataggtgttcacgaggatgatgaggacaattaggcgaccttgaaatggagaatggtgctagtttggcacttaccttgttcctggatttccttggaattacagaccttcggcaaccccaattactacctcacatactggttcttccatctcagcctctccctatgcccctgctcatttcctaggcactttttctgagctgttgccttcccttccccttgccagtcatgagataagtgcagacctgtccccctattctggcagtgttgccagcccttagactcacactaaccattcctgggtctacaatacatcctgggcttcatactcttgcttctagaggggccttgtctttccaccttgcagatgaggcagctcctcccacttctggcccagaccctgcccagtgcaattcttcctactgcgactaatacatctgtattagtcagttctcacactgctaataaagacatacccaagactgggtaatttataaaggaaataaatttaattgactcagagtgtagcatggctggggaagcctcaggaaactaacagtcatggtggaaggggaagtaaacaggtcctttttcacatggtagaagcaagaattgcccagcaaaaaggagaaaagcccctttttacaaaatcatcagatcatgtgagaactcactcactattatgagaacaccagcatgaagttaccacccccatgattcaattatctcctacggagtccctcccatgacatgtggagattatgggaatgacaattcaagatgagatttggatggggacacagccaaaccatatcaacatcctacaaagatgtccaaagacaactgtcaaatccaaattgggcatttcagggttagtcacagccactctgggttttattatattccttttgttcctcactctcagccaatccgctttctctttgtcttgtctttgccctagcttttgcctgttaactctagaagttctttgtctctttaaaattggcacctttgatgctttctgctaatcaaaacctgtggccatggtgaccctgtagaaagttggagcactagagctgccctcactggcccagggagtctctgttggtcaggctcatcccctgaaccacttctggacacttccatcccctcttgctcgtacccagcttcctccttatggccttgcagctcaggatccacaacttctgttttttgcttcagttttccccaaggaagcatcttagaaattgtctccttgactctgcacgtaagaggtaccaccctttgcacctcccatggcctttggttacccccagcagagtgtcacttgtcctgctgtgtcctgggggcagctcagcattttgtcctcaggtctgtgacactcctgcagaaatgttgttagatagatctatccttctcccagctgcaagattcaagcacattcctctcctctctgagcctcagtttactcctctgtacaaggagagtgagaagtgctcaagatattgttgccttttcctggggtttctgttattttctgggatttctttttgaatagggttgttgaggattaaatagtttatatatgtaaaacatgtaagagactaccacatgataagtgttcctaaaagaaactatgaacaaatccagtatagcaataagtattttgccaatagccatgttgggtggtatacaaaggggacctatgtaggctggggtgagggttccaggtgggttccttgggctgggaaatgattggaagccacagtttatcttaagggatctgcagcacaaggggagatgaggatggggctgtgccaggaggaaggagcacatgatagactctctgactagacctctctcgggactctcagctacttttcacctcttggactctgctgagctcttggattcctcctgttgaacaggggcaccaagggggtctggaacactaagagaagctctctctttgttcacttgcacttttctgttatattgattcttaatcagccatttttatgctcttatgggaatagcctttgaggtcttctgcaaatgtcccaagtgcaaaacaagatcaaacttcctcttcagatttctttttatcctttcttttttttttagacagagtctcactctattgtcaggctggagtgtggtggcatgatctcagctcactgcaacctccacctcccaggttcaagcaattctcctgcctcagtctcccaagtagctgagactacaggtgcgcaccaccatgcccagctaacttttgtatttttagtagagatgggttttcaccatgttggccaggatggtctctatctcttgacctcatgatccacctgcctcggcctcccaaagtgctgggattacaggcgtgagccactgcacccggccgtcctcagctttctaaattcttcacttgaccttggtctagagaggcaagagtagaaccccatctctcgctgactgcacccttctttcttccacaatgctccaaggtcaaaggggcagtattcatccttaagggaagaataagcccatttcccttcctctttattcctccctctttccaaagaagtatcccacatcctttttccaggaactacaatggttgacaaaactgagatagagtgagagagagagaaactagattatctataaggtgtattaagaagcattgtatttattatttagaagtattatatttattattatagtattattataattcagaagtattatattcattcacacataatagatgtccaataaaaatttgttgaattgcacaatgtggttgaaagagcatggacttgaaattcaggctggtctggttcaagtcttggctttgccacctactaaccatgtgaagtgaagactggcaccatggccatgaacagaaatgaaaattgtttatgccacatcactggagtgattggagcaaattcttttcactgtgctttgtacaggcataaacttaagattttgttttacaaactgatgattatattggctgttaacagagcttaaatcctggcatttagaaacctactttaatacttactcaaagactatctggtcagaaatactccccttttccttcttgaaatgttaaaattcaataggaaagtgacccgttcaaagatgaactctattttataaagatgttttcagtgggccatgggtaaaaaaatatttcataaaccaggggaagccactaaatcaaggagtgaggaaagaaatagacttgctaaagcagtaccatattggtgtgggaaggcgatatattcagtactttttactatatttggctgcaaactcaagacagtttttgccttgatctatgactgagattcagtggcatgggcaccatttgaactaatcctcctcggggcttcttgctctaacaaggagaccataaatgatgacgattgggtgagtattttgaaaaggagagaaggaggtccttttggctgcaaagttctgatggattcatggagctactgaatatgcctattggatcacaggaaacatgcaggtggaacatggattgctaacaatagaaggcaagactgagactaaagtggattcaggaagaaggtgtctctgctgtcaggtggattactttggaaacaggctctgagagagattttgcaggcaggtttataaggaatacacttgggatctgcacctgtggatggaaggagaggaaagcagaagaagacagaggggaaaatacagctttaatgtagcccaaagacaaccccagttgaccccattgggaaatctggtagaatagccttcaaagttgaccccagctgggctaaagtggctgggtttttaaactgtagcacccatcagttgagtccagggtactccatgaaagagtgtggccttgggtgagatggatcacttgggaagctgaggcaattgttgaagaggctgacaggtgaaagatgttgctcaatggtgctcattgaaatgctttttggagaacacatcacagtatccactgagatctttctcaagggctgagaatgccaagtctgtgcatacttggttgcaggtttatatgctaggtttgaagatccaactattaattgattggataaatccttgctatgttagagatttggctaagaagaagcaaagcagttcctttcaatcatccagactgctatggaatctttcccttcctgcaagcatgagtatatagactgggatatcattgttgttgagtgtggactctggaaacagatgaactaccttcaaaacctagctcagcaaccttccagctgtctgaccttggaacaatgacttgacctctcttaactttcattttcttccctgtaaaatgggaataaggacagtatacaatttatatagtgttgcaaagctctttctttgtgcatgcctcacataattagtagtcaataaaagttagcagttgttgttatttgtcctcttagtagtatatcagagaaaaggaaggatttacccatttttttttctaatcctggtgttagcacaaagacagtagaagtcccagcctgggctttgtgggcagaggtcctgttagggtcacaagtgtacttctagagagtctctagggtcagctcctcttgaaatcctggagatgactgaaaccacaaaattagcttctgggttgtctttgcagggtattctacttgattataactataaggcaccttggatcatctcaatgccaggaattatcaatgttaggccctgaagtttcagttatatatgtgtcaattcaatacatggaaccacatgggtgtatctgagtatacttgaatgttaaggaccagtgattctcaaagtaggtccacggaccagtagagacaaagccacttgggattttgctagcaatgcaaagtttcgtggcctcccacagacctacagaaactctgagggtagactccagccatctgtgattctgatgcatgctaatgtctgagaatcaatggtatagataaggggttggtaaattttattgtaaagggccagagagtaaatattttaggctttgcagccaatgtgatctttgctacaactactcaactatgttagtataatgcaaagcagccatagacaataaatgaatgaatggtgtatggctgtgttccaattaaactttattttaccaattaaactttatttaaccaaaactgccaggccacagtttgtcaatttctggaataggcacatgtaggatcataatttactcccttaaggtgattatttctttctctagaatatgttcattcattcatttattcaatcattaatttaatttaatttttccattgtgtgaggatctctgcatgctaggcattctgataagaatcaagagatgcaacaataaatgggacagacaccatccttctatcatagatcttaaagtttaatgctagacacaaaaaggtaattcacaaataactgtcgcaataactgtatgacataaaggatggaattagaggaatgatggggtgaactaatctagtctagggagggtagaaaaaagcctctccaaggaggtatcctttaagatgaagtcctgagggtagtaactaggtgtatattacccttgtacgagctttgtcctcatagctcattttatcctcacacaactcaataaagtggacaatattattattcatggttcacagaggaagaggttgaagcccaagaaggacaaatagtgtgctcccagatttgaacccaggcagtttaggactagaggcagtgtttttaacgacaattctctactaactagttaatgggaaagagaagaacattcaaggcaaagagggcagttcacagtctcgtggggtactcactaatttcatcatttcattttggggagcctgttgtaatctaggcatcatgtttggtactaagcatgcaacaggaaaaaagaaagactttctgcttttatgaaacttacaaatgagtgcagaagacagacattactgaaaactagggggaaaagggcagagggagaatggaaaaggtaagagaatacaacggagtgaagagaaagatctgaggctttaatattgaacagagaaagggtagagagattaacaccaaatctcctttcctcacttcttttgtcaagttatatctctagggcttttgatgattaaatccaattcttgatcaacaatagctggaaaagaagtctctgataaaacatttttacctgtaggcactcaaatggagaactaaaatgaaatgaaacatgtaaacttgaagtcacagttgaattacaggttgacaattgggcactgaatatcagttgaagatataattgctcctctaactgccgtttccaattgcagggcccagttgtgacgactgagctccactaaaatgggaccaagtataatgatatgagtaagttgaaagcaaaaggatgtaaaaagatatacttagcaaatattactcagagattaataagatattctgagagagaatctctgatatctatgagtgtgactcagagataatgcaaggatggctatgttaatatacaaaacaggcttcagagcaaagaaaattactagctacagagagatgtagtacataatgataagtcatggtaatactaaatgtgtatataccaaacaacagagcagaaaacatgtaaagcaaaagctgacagaactgaaaggaaaaagagatgaatccatattatagttgaagattttaacactccctctatttcaacaattggtagaacaactagagaaaatcaccaaagatatagaagaattcaacaacatcatcaaccaacagaatctgatttgatatttatggaatacttcttccaacaacagaatatacattcttttcaagtgtccacaggagaaatatttttattaaaaacttatacaaatttaatataatttttatcattcagagagtgccctctggccataatggaatcaaactagaactctttaacagggagataacagacaaatttgcagaatcttgaaaagtaaacaacacttttaaataatgcatggtcaaagaggaagcctcaagggcaataaaaatacagtaaaataaatggcaatgaaatataacatatcacaatatgtgaatgcagttaaagtagtgcaagagggaaatttatagcactaattgcttactttagaaagaagaaaagtttcaaattaataataaaactcacatttccagagccttaaaaaggggagaaaagtaaatccaagacagtcataagaaaggaaatataagccaggtgtggtggtgcacacctggagccccagctactcaggatgctgaagtggaaggattgcttgagtccaggagtctgaagctacacagtaagttataattttgccactgtacttcagggcaaaagaatgagactctgtttccaaaataaaaaaggaaataataaagataacagcaaaaacaattaaaaatttaaaacaattaaaaaatcgatgaaacaaaaaactggttctttgaaaatatcaacaaaagtgacaaacttctaacaatatttacaaaagaaaaagagagaagacaaaatattgacatcacatatgaagcatatatcacaacagaccccgtagatatcaaaagacatataagaaatgctatgtataatacattacacataaatttcacaacgtagatgaaatggaccaatttctcaaaaagcaccaactaccacaattgatccaatatgaaataaatatttgaatagccctgaaattattaaggagattgaatttgtaatttaaaaacttcccccaaagaaatctccaggcccagatggtttctctgtagaattctatcaaaagtttgaagaagaattaaaacgaatactatatgatctattccagaaagtagaggcagaaggaacattttctgattcatttcattacaccagtataaataaaagaaaactatagagcaaatattcttcgtgaaatgaacacaaatatttttaacaagatattagcaaatataaaaaatatataatacataataatattatataatatgtaataaaaataatacattgtgactaagtggaatttattttagaaacacaaggctgtttaaatattcaaaaatcagtcattgtaattcaccatattaatggactaaagatgaaaaaatcacataattattttgatgatacagtaaaagcatttgacaaaatttaacatttattcaggtaaaatcacagaaaactatgaatagataagaactccctcagctaaattacatatatatatatctataataatctactgttattattatacataatggtgaaatattgaaagtttcttccctaagatcaacactaaggtgaggatgacaactgttaatactgtcctttgacatagtgctgaaagttctaggcactgcaataagacaagaaaggaaattaaaaacatgtagatcagaaaagaagaaataaaagtttcactctttgaaaatgacacaatgtctaatcccaagaaattaacaaaaacttacaatgaataagtgagttccaaagttttcagaatattagatcaatgtgcaaaaatcaactgtatttctatatactaataaccaatatgtagaaatccaaattaaaaatatgatactgcttaacaattgttaaaaatgaagaaatacttaaatatatattgaacaaaatatgtatgggatttttattccgaaaactaaaacactgatgtagtaacctaaaaaggaaattttttgaaatgttgagacataccatattcatgaattggatgacttaacatattaaaaatgaaaattctatacaaattgacaggtttaatgtaatttctatcaaaaccccagccaggcattttgtagatacagataatattattctaaaattcatatggaaaggcaaaaaaaaaacagtatagctaaaacacttgaaagaaaaataaagtgaaagaaaacactctaaccaatttcaagatgtatcatgtagctaagtaattaagactatgtggtattggtagtgggtaggcatcgatggaacagaataaaaaacaaaaaaagtcccatataagttttgtgaactgattttagacaaaaatgcacaagaaattcaatggaggaagggcagtcttttcaacaaatggtgctggagcaattagataatcatatgcaaaagataaatctcaacttaaacctcataccttatgtaaaatttaactcaaatcatatatttaaaagtaaaatataaaactataaaacttttagaaggaaacacaggagaagatcttcaagactgagtggttagtgaggacattttagacatgacaccgaaagcacaaacaatttttaaaaccggttaaaaaaggtaataaatgcaacttcattaaaattagcccaatgaaacagaccaaaattagtctgtgaaaggtccttttaggaggataaaaagacaagctatagactgggagagaacagtatttgcaaaccacttaataaagaactcatgtgaaaaatatttgaagaattctaataactaaatattaaaaaacaatctaattagaaaatgtacaaacaacaggaagaattatttcactgaaaagtgaataacaagcatctcataacgaaagatggttaacgttattagccatgaaggaaatgcaaattaaaacaaaatgaaatatcacaacacacttattagaacagctgaaataaaaaaaagtgaaaataacaaatgctgatgaggatgtacagaaactagatattttaaacactgctggtgaaaatgtaaaatggtaccgccactctggaaaatagtttggcagtttcttaaaaccataccactcagaattacactcctggacacttatcccagaaaaataaaaagttatattcacagggactgttcatgattgttcaaggcagctttatatgtagtaagtcaaactgaaaacaaccaaagtatcctttatgggtgactgactaaacaaactgtttacatttacaccgaagaatactactcaccaataaaaagaaacaaactattgatattcataacaacctggatggccctctggggaattacgctgaatgaagaaagccaatctcaaaacaccatatgctgtactcttgtacttacataacattatttaaatgacaaaattataaaaatggagaacaaattagtagcaaaacaaaaataactatgacgcattggagacatatttgtattaagtatggtcgaaggagaattaccctctatgctacaaaaaacaattcctgcaaacagaaaaggaaaaaaaaatccataattttaaaagttaaatatggacataatttcaaaaagcatagacagcatagagctcacaatatagaaaacaaaaatggctaataaaggtagacagtgtttaatctcagtggtaaccaaagaaatttgaatacaaaatcaatgtgatacagtttgtcaaataaattagcaaagtttataaaaacaacaacattctagggaggttatgatgagacaaaatactttcatccataattactagagtagaaatcagcatacaattgggaaaacaacctgggaaaatatgtcagaaaccttaaaaatatttacaccctcgaccaaatatttgcactttctgacatttattgtaagagcacagcattagtttcttagggatgccatacaaggtaccactaaccagcagacttcaacaacagaaaagaattgtcttgcagttctggaggtttgaagtctgatatcaaggtgtcagcaggatgtgagacagaatctgttccatgcctctcctctagctgctagcggttttctgtcaatctcctgcactccttggcttgtaagtgcatcactcagaattctgccttcattcgcaggaggtgttctccctgtgtgtatatctatctgtgtccaaacttctgctttttataaagataccagtcattggaatagggcccacccatatgacctcatcttgccttaatcatctgcaaagatcctatttccaaataaattctcattcacaggtacaggggattaggatttcaatatctttttgggaggcacaattaaagccataacagacataatctaaaattcaaaacaacaactttattttagtataaaggaattcatgttatttattagtataaaatattaaaaataatacaaatacataacactgtgaaatagtcagatagtgctgggattacaggcgtgagccactgtgcccggccaaagcttgggttttatagacatggacagaatttcctgaagaccttgtttcaatcctacctagtggcttagccacttcccctctctgaacttcagtttatccatatgtgaaatgggaggacaatgcgtgatgctgattccagagaacattttgagggtcaagctgaatctacccctacccttggcagcctctgctacaggtacgtcgtaaccctctgatgtctaagctgttccctcctgcatattcttctaccagtatcctatttctgaaatagtgaagccagtcctattccttcttaattctttctgctttgtttgcaaggttctaactattcaaatttaatttctctacttgcttccattccttgactttcaggatattatttttatttattttcccatggaacgtttgtaagtgttgaatgattttgttatggaattgtgaaattagggaatttagttctggaatggattccccaaaagataatttattcagataattatggcctcactcttcctttgaagaatactagtatttaaatatttaacaatattaattacaatattttatatttatatattgcataatatattattttaataatatttttaaaaataaagtgtatatatgcaattgtggccagaatttgtgaactgttgttgatactcactcaagacattgcagcagcaaaaagattcttagatgtattaatagagggctatgttaattccccactatattttctatttgcctcaggaaacaaattgccatttggcattactattgttttctgagaaagaaaacttctgctaaattaaaggctgcttcacgagctgatcatcttgattcatttagcaatagaagtaggagtcagaggttgcaaaactgttcatcacagtatgggatgagtaatttgaagtctgccgaattgaggaggcatggagtgaggaagagagagggagtaaaagcaagagggtggggggaggagaggaggcagtgggcactgggtgggaaggagtcccaggtgtggagtggcttttctttgcagacaagaaagctaattactataaaaattcctgttgtgtgatctctttgtgaaacaacagcttgatttgaagtctactacattaaaaatgctgcatgtgacttatttctgttctatattttacttgctaatatgtatgtgtgttttaattgatgagaagattgatattcatcccacacttaggtggtcaggaatcccagaggtagaggaggccacaagattctaatgattacaggtacactggaatttggagaaatcttggggaggccacaagctacacaactgggaattcaagaaaatcatgcctatgtctccagggttatgaagcttccagctgacctctggattacataagagcataactaccttctccctctggtaggagcaggaccctggaatgcctctccaccctattctcccttcctcttgggctgcagctgctgtagcaattgtccctagggcctcttttaggagagaggaagcaaagcctccaacctacacgttttaaaggactttttaattgaggaaaggttgcacaatgcaaatgaacaatgggtctcacttccaacctcccccagaaagaagctgctccttgattgacaaaggaaggaaatggaagctagacatttcagaaaccagcactagaataaagagatcaatgtgagacacattgcaggataggaaaaccaaaactatttccaatcactgatccaaggctttcctttcaatctcttacgggaattagcattttagaaaatgaacaaggcagccttgaactacccagagaaatgtgaacttctgagccttctggtcactggacttgtctttggatgaaaagagaagaaataaacgtatattgagtacttgctgtgtgataggctctgtgagaggtgcttcatgaacactatctcatttaataccatttaacaatgtccctatgaagcgtgcataattatctcactatataggtaatggatttgaggctcactaaagtgactatttcagtgaatgtgtcaaatactgctgaagtggcttgcatgtgatcattttgggaagatggtcaggctggtagctactgtattggacagcacacatttatagaacatttccatcattgcagaatgttctattggtcagtattattctagagaaaatataagagcttgaaacagtcccaggcagtagaagagggtatttgcaaaagtgggagatatggtaggagtaaagcaggacattggtgctccaggaattaggcagaggttcataatttagggtcttgaaatgcaatatatggaagatccaaaccagggagtagattagatgatccttcaccgagactcaaggatgatcaagttggaggatattaggtgggcaatgctgctcagtgggtggagcttcagacagactttatgcctgcattttgaaggtcgacatgggaaatatgccatgtagtcatctttgtcccagctgggtaaggaactggtatggttgagccagcactgacctaacagggcagagctgtggcaggaggggttgaaaacagaaaccttcacctcattttatgctcacttgcagaatctgtgagtgagtgtgtgtgtgtgtatgtgtatgtgtgtgtgtgttggaaaggcaaaggcaattaagcatgctttaatccttgactgagtagtttattttcttgcgtatcctgaattccagtttgaactctactgagtgcatcaaattggaattgaaatcttagagaggttttagcatccaaataactctttctcttctctttatctgtgagggtctcctttaaacctgagtccactttgagctttcttatgggataaaaagatgagttggctagggcaataaaacaactttctctttaaatccatgttggaaatgtttacctagcttggtcataattatgcacactactctggactaaatagaaaagaactaagtgatataaaggacttacattccagtaacctctatattagctcagcaataattccagcaaaaatgttttcatcagctcagtttctgttttcagaatcagctcttgagctatctctaagaagcagttaaccactattattgttagcatacaccaaatataattataggtaaaatgcttgaatgagatacttcttgtaggagaaatggagtctctgttaaattcttgaatactatattcatgttggagatttgcaaaaaactttttaacaaaaaaaggctctgagaagtcctgcagtaaagaaacctttttccccttcctgtgtccatgtgttcccattgtttaactcccacctatgagtgagaacatgcggtgcttggttttttgtctttgtgaataaacaaacaaacaaacaaacagaaagaaacctttttaattctatttaagccagaatttcctaaattagctcggaaagttttttattttattttcttgtttgcttttctgctttcttctttgttatgcatgaaacatctggagaataaagctctatacagcatagtttgagaaacactagcataaatacggcagaataatgatatggagtggaggagatgtttgtgtttgggctgtgttttactttcaggaaacctgaaacaatgatgggtatttgggggaagttatagttttcatgagcctgtcatgaaaaatctgagagaaactcttaaaactttgtgattgcttctttaaactattgtccacattttattgttgagcataaactctacactaccttttatttactagttcaatttcaaacattagcaacttaatgatcactgcaggcaaaaatttaccttctgctgtaaccttcagaggtattttattcaatactttgatgaagcttatggtgaactgacatgatttgccaccacattagtttcttaccatctttgtatattatcatggcctcctaatttaccttcatttcttgcaaatcaccttcactgttccctaaaactccaccgtattactatgacaaaggtcatcacagcaagagttgtctacttgaaccacatcatcactctccactggcaacaaggcagtatatacattaaatatgtacaacttttaacatgccagtcatacctcaacgaaccacaaccagtttcttggaatcatttgagcttgtgacccctgtcatgcctttgctagtgccagtccttcctcttgatgagtccttttctcaactcactcatcaaacatctagtcaccctccaggacccagttcaattgtcatgactcctgtggaatatttcttgatatttgcaggaaaagttatttgttcctttttctgtgctcctattgtgggtttttgttttttgtttgtttgtttgtttttgagatggagtctcgctctgtggccaggctggagtgcagtggtgcaatctctgctcactgcaacctgtacctcctgggttcaagtgattctcctgcctcagcctcccgagtatctgggactacaggggcctgccaccacacccgggtaatttttgtatttttagtagagacggggtttcaccatgttggccaggatggtcttgatctcttgacctcgtgatccacctgccttggcctcccaaagtgctgggattacaggcgtgagccaccgtgcctggcctcctattgtgttttctatttattcatacttttggctttgatttttaaggcataataaaaattattggaaaaaaatcctgtgtcaaagagaaacttgaaaaaaaaaactatattgaactccatcttctcttctagctttatttgacaaagttacaccattgccaatatttaaaagtaccacatacattattccccaagcatgaggttatatgtgttacaaacattttctcttcaatccttaaggcaaaagtgaagattttatccctaccctccagatggctttatccaagtttgtctagctccaaagatctgtaaccttttcactatgtaacactgcctctcaggtgcatgactagccatgctgtgtgtcactcagcacacttcatatttataataattgcttttaattctcagataatccttcaaggcaatattagtatccatatttataaccaaggaaagtaagtcttacttgccctaggtcaatatagtagtaaatgttagcttaaaaccctatactttttccggtgtatcacacagcctcagctttccactgttcaggagacagcatcctcgggtttcaaatggacaccaggaagctctattggatctttagtcatgaaagttgattcagaaatcacactcaagggtgcaacgattaaccattaagaacatacagggaaaagaagaacatattaaagaacaccactggctaacacaaacaataaaatccaaacaacctcatttcaactaacatatttcaaggaaaagaaagggagacagttagaggaaggggaaagagagagagggaggaggagggagggaaaggctgtagattaaaagataattaagtgcatgtgtgaccttcattatatgtgggatctaaaatagctaaactcatagaagcagagaatcacatggtggttgccaggtgctgagaggaagaaacagaaagaggttgtcaaagagtacagcatttcagttaggcaaagtaaataagttctggagatctactctacagcctagggtccatagctaacaataatgtatcgtatacttaaaatttgctaagagagtaggtcttatgttacatgtttttaccacatataaaaaatgacaataataaacagggcagaagaaaactttggaaggtaatggacacatctttggccttgatggtggtaatggtttcatgggtgtatacttatctccaaactaatcaagttgtatacattaaatatgcacagttgttaacatgtcagtcatacctcgataaagtgatataagcaaataaattgcaatgtacatatctatttcaatttttattttgattaaacataaattataagaagatcaggaaaaatctgaatactgattgtgtatttgataaaattaattaataattgttcatttgtgggtatgataatgtgattgtgattatgtttaaaaaaggaagtcctagatttatagagataaatattaaaatatctacatatacaataatagatattttggatatgctttcaaacaatctgggacagaggccaatggatagaattccggataaaactaaattggccatgagtctataattcttgatgctggatgttggggttcatttttattattctaaattcaaaccttctaattaaaaaaattaaaaattactaattagccgaacatattcattccttgagaagggttcatagaggctttgaatgttttgttgtcaataaattaagatgtaaaaggagaaaatgtatctttcagccatattcttatccctatagccagattcttgttttaccactcaagagcaattcttttttttttttttttttgagatagagtttcactctcgtcacccaggctggagtgcaatgaggcaatcttggctcactgcaacctctgcctcccgggttcaagcaattctcctgcttcagcctcccaagtagctgggattaaaggcacccgccaccatgcccagctaattttcatatttttagtagagacggggtttcaccatgttgatcaggctagtatcaaactccggacctcaggtgatccacccgccttggcctcccaaagtgctgggattacaggttatgagccactgcacccagccaacagtgattctttaggactacctacttagccataaattggcaaggcaaaaataatcacaagcatttctccttgtgcttcatgttacttgttgtcatggcagcctgtattttgaaaatggatttgaatttgcccctggatgtattaaaatatattaatttttggcatggaatgaattttagttttgtatcatgtcatcagtataaaagattccaggagagaatttatgtttgccaaggtgccattggtgtgataatattaagagtttccatagtaattcttcctactccagtgctaatttgctctcattgagcatatgttgggatttcccagaaggaagaagttagatggaagcagcatgagttggacactgggagggatgaactaggcctgcttcagaaagagagcagtcactttaatcaccaaatccaaggagtaaagcaaagtcacattccatctgggtcaaggttgatgtgtgaggagtgttattgcaggaatgggaaagagtggcaaaggggtttggatcttagcagagtcctctttattctctcagtatcagactcattcaacaaagggtcttattcaagatgtggtagggctgctcaaacaaatgcagggcctgtggagggagagcctggcttggggtcatgatgctttcccgggctacattactcaaagcctcaagagcatgatttgccaacatggccttaccctgggagtgtaataaatgaaagaactggtactggaggccagccaggcaatcaggccttaggcaatatataggcgtttgggaagaaaggactcatatagacacctgagtatgcattctctctcaccactatgcatgttgaccatcatatacaaaatagtaactatttccaaagctttctttcctcataggcagggaggtgctgacaccctcctaaattaggtctccattgccctaggattgggtagggttgtggatgctggtggccagtagtcagtgcctgccactgtgctggtcagggctagggaagttgagtgatgggttttttccaactgcttcttttctggcccatgagaacaacggaaggcagcatgacctggaagatgagatgtggcctctttgccagcacagtttagagctgaacctaaggctaatgctctgggccaatagtcattgacctctaaaaccaaggcttccctgagtcagggagcctcaaattctgcagtctgcactccacactcttcactgtttacttatctgatggagctgttctcttggaaagctgtgttattcctgtaatgcaaagtgacagagaaaataaaaacacccagctgagaaaaagccacaatgttaatgtgaaacacaaactttctgttcatctgaatctcagtttattttaaaacagaaccataacggctcagatcctgaagactgggaagcactgttgctacagctgtcccactctcagatccttctctgacttgccttctggtcttaatccttagcacttttcccaggaaggaatgtcaagtcaaggtggtaagatgtcagattgccctccctgaatatggcttaaagaccaagttaagagcaaattcttaagtttgcagtagatgaaccagaaactagtcaccatatgctccccactaacactgaagtccctctggctgaataaaagcttggcctgagtttcccaggaggtttgttctggatgaatctggcttttgtgttccatctgaaccaagttcggggtctaatcccaaactctcacaagctggcattgagcgacatctgtttggcatcttctataccctgttttcttggtgtttgcctgcattttttggaattagctcaattttcttatttttttttctggatggtttctgaacagtactatccatataagaattttagtcatataaagccctagggagaaccctgctatgtaggctgcttcctgtcctcattccacccccaaactggaaaaacaggagcccatggtggaaaacaaagagaagcagtccaagtattagaagaaaagcaggaaattgtcccataggagagtgtttcatgaagcaaggatgcaacaatacctcaaattacacctctctaagaagaaagtttaaaaagtccctactaagttaagaattagtgaccttaactaagtagggttgtgatggtaaactcagaatgcaataaattaaaaagtgcatgagaatgaagaaaaaggagatactgccttttcaaggtacttgctctggagcaccagttcctaacttggtgtgcacactagactcccctggagaggatttaaaaaatattgatgcctgggcttcatcccggagattctggtttaactagatttaggtctttgagggagcatattttgttttattttatttttaagatgaaaatcacttgacctatttgtagcctaactataagtagctaggagaaagggagaaattaaaagtacaaagggagtggttgggtaatgatgtcatgggatggccaaaaaggcagccgctgggatccaaagttcaggtggttgatcttagacctgaagaggtgaatcaagaccaagggggcaaggtggcttcctttgccaatgtggaccttcatctggtggtttttagttcatgacgttggaggctaagctattttctgagaatcttttttgaccaaaagcagaggatctgatgacatttttggcttgattggccaacacagccttaccttgggagtgtaataaatgatacggggaaacgtcttccctggactttagtatgatcacaaatgctttggtgatggaatggggatagggtgaataataaaagcttactgacagtaaatgatgacttgggaaggaaagactgggcctaataagacatacctgaacccttccatgagaacttctaaaattttagtgacaattcatttaaagagcaattggtcagtcaccttaagttggtcatggcgcgttgtgctggagaggaagagataaacccagactagaacaaaccagtgagctgggaaaaatgagacccaagaaaacagagatgcccctggtggaaaaccatgaagacagtgtggaaagtcaatcagacaaagtctaggggagaggacaaggctggcagtgaggaagtgggtgagttccaggcaactcttgtggccgctgggtcttttctgtggttctgtcacttcctttgtaagtggatgtgacatgagtcttgaagggacagataagaatacctctcaccagggtttatcattattggttcacatctgtcatattcagtagaatatgtattttttaaagaaattaggtttgttttgtataaagattagatgtatacaataaaaatattaagtaataataaaaatcacgaaataaaaaggaagagaatccctctacctctacactatgaatcttgcttcccagaggtaaccaccattaatattttttgggtagggattcttctgtgtgcatgtaggcataggaaaatgatcactcttgtaatatcgatttttaaggctaaaaaccagataaatacataatactgtgataaataagaaaaaagtaaggtgctacaaatgtctaacatagctgcttgggaaactgacaaactcagttttaaatggtatgtataagtggtgaggaaaatacgctaaatgtatatgagtggttctgaggaatagtgaatgaggaatcactattttatagtcatattctctactggtgaagtcatagatagtcatattctctacaggtgaatcaagagggattatcacattttgcagtaataattttacttgctctgaagcaccattgagaatggattgttaaagagataattggtgagcctttacctgtgaatgctgtactcatcaggaaccagcatgcacttgcagaaataaatcaggaattaagttagactaccagtgttgttttttttaaagggtctttaggttggtagctaaagaagaaatataaatggtgttcctcaaattaattgggggcttgaaatgtgatatcatgatattcttgtggacaagatggaggtatacgttctagatagtattgaagttggaaggacttttagctaacagcagtcaaggaatgttataaactaatcaacctcagctgaaagtgagagcagctctatcctaaggtctgtcttattatttgctttattttgactaatttctgggaaaacatatacaatgtctctggtacatagtagatgatcagtaaaaatacttgctgaataatgtgatgtgaaaatgaatgcaggaaaaagtgatcgaaggatgacatgaatttggaaggaacaactagctaataatctgggtgatgcaattaggaaacaaactaacaaacaaaaaacctcttggacaatggcccaggtagatcatccacctgccgtgcagtaggtgaaaagaatgaaagttctcacctgctgcatttgttctttcatttgatttgttctttcatgcaaatctcagcttctgaagcagagagagcaggctggatggctgcaagtccatttcctgagcttttttgttccctggctgtatgctggtgcaacactgcaatgaatttgaaggaaattgcagagttcccccaaatccatcctgtcttgtctggtactcccagagagcaatcatggttagccattaagactgtatcacctttctaccgaacagtctcttcaagaaactgctaacttcttgtggcacccagtttgatgactgtaggaaggagtctccagccccttggcctctggctgcattcctggaaagacactctatctcttagttttctctcccctcaatttattgtcaaaccatgcaaatgaggcttccttaactatttcttggacatcttaaaattaaagtctgcacattaataatttgttcagcttgttggtaaaagtagcatcaatattatgagatcattggtctggcctgggttctctattcaaatcttcatttccaggagctaaggatgcccgccctcctcttttgagtcccacacccatcctctcacatatttatctacttcaattaagagtgggaaatttgttcaagaggagacagtcctgggggacatgaagggaatttttttgtcagggaggcaatgtaaggtctgaactatatggtcatcttgttgagagcagagtctctgcttgcttcattctccatcctttatattcttgttacttaaagtgtagttcacctcacctgggagcttgttggaattgcagaatccctctgctgaatcagactctgcagtttaatcagatcaccagtgatggtgatttgcatgcacattaaccttcagcagcatgggtctgtattacccaacaaagcgtggtgaaggaggaagtaggcagctaacatttattgtgtgagatggcaggagagagaggaaaggaagggaagaaaaaggaaggggaagggagggtaggggagaggaggagaggagagggcagggaagggggggaggaggggatggggagggaatgaaataatataaattcacatggggagaaaacagtctgaatttgtgacaagtatgacataaaattttacttagtttgcatatggtaacacaaacccattgttacaactttctactttagtaataaagtgaatattgtgcaccttaggagaaattactcacatatttacattttactttcttgccttggaaaggtatttttaaaataggttaaatatttccatggttctttgatcaatattttagaaaatggatcataaatagaagaaaagtgaattactccctagttcaggacacgttattaaaaaatccaagttgggccaggcactgtggctcatgcctataatcccagcacttctggaggctgaggtgggaagattgcttgaggtcaggagttaaataccagactgggaaatatttcgtagagaccctatctctacaaaataaataaataaataaataaataaataaataaataaataaataaaaattagccaggcatggtggtgtgagcctatagtcctagttacttgggaggctgaagtgggaggatcatttgagcccaggagtttgaggttacagtgagctatgattgggccaccgtagtctagcctgggtaatagagtgagaccctgtatgttaaaaaaaaaaatcaaattgtggagaacacttgatccattcatagagtaagcatgtttcaaataatatacagttgctctcatgaagctcatggtctagggtaaggaaacaaatctataaacactgttcccccaaacaacatattacagttactatattatatgctattaaaggtaggtaccgaaagacaatttacctttgccaagagtggggaagggactggagaggacaccccagaggatataattgctgaggttcatcttgaggactagattggagtttgccaggtattcagtcacaagacagcagtgtgtgctaaggtcatagagaggacaacatgtcttagggactgaggtgtgtggtgtggctgaaactcaggctttggggaaacaagaggggtgaagggacatgaggttggtgaagtgaacaggagctagatcagaagggccctgaatgctggtctaggcagatgaactcctcctgaaaggaaggtttggatcagtatcttcgttttagaaagataatttgagaggttatgtgtgtgatggatagataagggtggtaatggcaggaggaggagagagggtgatggtgaaggcaggtggagtgaggaagcccagtgaactgggctgttgcatttttaaaataagactacatggtcatggcagattgacttcaggcagtgaccaaccataaagctagaaagaaccatgaacattttagagacattcaggaaggattcagctttattatcctgtgactgccttatttgttgacaaaagttctccaacgatcaaagccccattcctgagatttttggcactggctgtagaaagaacaggaacattagaaagcccagaagctgttttctttcattactatgttttgttttgctcctcaagtaactcttgccattctgtgaagctttacagaaaatcccaagtatcttttaccaccaggataagcttttctctatagcctaagtttaataattcacagttgtgaacacatttaaagagtgaattcccagtcagcatgttcattgtgaattgacatagtttctttaaaggcacatcgtgggtagtgcactacatggagaaagaaatacaggtagggagttgagaagggaggcttgttgaatattttaaagagttgacgggaccccaaaagcctgctttgctaaatctgaacattaaactcagaagcaatgtcgcttggattcctgggaagcatgtgtcctggagggtggggattgggacggtgttgtcaattcttccatttgcattttctcctgactcttcacctccaacctttttgtattcagaaatgcaacctggctcatctttatcctcccagtactccagggtttctaaattgaggatccatagttctctgccgagtcttggaatattttgaaattgaatgcagactccatgtgtacatatgtagctttttgacattttcttggcagagtccttcacattacatgagattctcaaaggcatctgttatgtagcaaagggaaagaatcattgctctacacgttgtggcctatccccagccctgagcaagtgcatcatctccgtctttgtcaggatgaattccaaaaccctctttccagctaatgctattctagtgagctcctaaccactgtctccactgcctgtttggcagctggagacacacagcaatgagcacacccaaaacctgagcttgttaccttcctcctcaaccttgtgctcctcctttgtacatgtggagtaaaatgccctttatttgtttttttaccatctgcagtcaacctgtcattaattcttgataacattacctctgtttttgaaatttactcccttttcttgattctctgttacttagagaacccatccaatctacaggatgtaggagagcccattaataagtgattctagtcttgtctcctatcatcatgccaattcagactccaactgcactatgtatattgttcttcatctctctgactttgtgcaagctgttctctctacctgcaaagatctttcctttatcagatgcttgataatcacatctgtgagactccattcaactatgacgtcttgatgtcttcttgacaattcaagctactcctttcctccatgtgtatgaaatgtttctggcatagtacttaattcagtgagtttatttctctgtttctgtacccatttctccagctgggtactgtggttcagaataatattaaattacacaaattctagagttactcagagtcatggataacaatgcccagtccactaaacagcttattaaaatgcccataacttccaaagttctcccataccttctatacctttgctatgttaatcagtcgtaataaccctttaaaagaaaaccttttaacatattttctgtttatctcaaatatttccttcctttgtcctcaaggttgggcagtaattgggaaaaaaattctattttcctttctttccctgatcccactcaagttgagcaggccctggctccgtgcccacccacctttattccagatgttaccctggcgaacatctaagtctgtaaccaggcaaccattgggaagagggccttcctggctctgggcctagaaacaaaagaaaaacaaataggaggatgtcttgagtcttctacttactttggttttccaatctcatttcccccaaacttttattatttttgtaatggaaactgggggtgggtatctgggctgtctgttcacacaccaaatgtccggtctgttatggagcagggctctggctggatttgatcctattgatcctgatttggggctatgactgccaaggaaaacattcttactccccctctcaccatgttggaaaggaaagcattgaccatgtggccatgcagtgatgaagtttggggcccagctgagacagggctctcaggcaactgaatagcttcatgcagataagactaagcataccaaatgaaatttctgtggccagttagacatcccaaaacatctcttcagtgcacatccctcttgccctctttgccttctgcctagactgttgttaattgttgctgtggtttctttttaactgcatggcttagaattctaatcctgtcttcctgattctgttggagaagtcatcttagacataatagcatgaccccatttaaacccattcagtggctcttcttagcctacagcctaatttcctaaagtctggaattttgtcgttgagaagcataatttattcattcaacacttacttcctgagtacttatcttatgccaggtattgccattcttctaggtactgtggatagtccttgtaatcaaaatacagtaaaacctcacactcctgaagcttgtattctggaggcaaagggagaaaataaattaacaattaaaaaatacagtatgttggatagtgataagtgttatgaaaagcaataaagcaaggagagaggatgcaggtacaagggttgggggagtctgtgaaaatttcctgagaaggtgatagctgagaagagaaaagtagttggtgacagacccaacctagtaggggatatctgtgggagaactttccaggtagagggaagagtaagggcagaggcctggccgtgggagcatgcccgatctatttgagttagaacaagatgtccaatgtggctggagtagaatgatacaaggacagaggaaggagagacgagtttagaacagtggcaaaaggacgtactttatagattctttagaacattatgtggactttgcttgtcacatgcagtgcagtgagaatccatagaagagttttagattttaagaagagcaatcttatgatctaatttacttctagagggatcattcaggctcctatagaaaatttattgtagagaggcaagtggggagatttgttaggcatctattgcaatagtgtggcaaaataatgggggatttcgccagaattagatgtttttgccagtgcctcctctttgatgattttctccaaatagacatcgattttctggctgaatttctctggtcacaggaaacttgctccctactgtacttctttgggtatgctcagatctttagttattccttttacttttactgttcctattactgttccttttacttttcctattcgttttactgagacagagtttgtcttctataggtttctttccttcatcattttggtcctaccccttaagttaattaaaaacaaatctttttcctcccttcgctaccatgccatcttaggcccctcttctccagaatcagtatctccagtccctggctcattcattgcttaccattgtcccagtcacacctctccatcctgagcaccctcctgtgaaggctctttagctgggagagtggtatctttgccaacttggaagtcgggggctacagaaaagcaaaggctatgtagtctggatctttacccttcagtaacacttagtcacagaggtcagaagggtgactgacctctgtgctccagctgattattattattattattagtagtagtagtagtagtagtagggtctacttcatttccaccacctttttttctggggcatagtaagagttaacttctaaacaaactcacactactttgcaagcaacagcaaacacccagtgtaatactgtccttataaaatatgtctttccataatgtgacccaaagcatagagaatatttttactccagcatttcctgccattaatgttttccttttgcaatcttcacatagtgttatgagtgagttgtgtgttacaaaaagctacataaacactctcaccttgtaatctactgtaatggcattagtaaggcagctctgggtttcactcttctttcctaagtgtaacaaacacaaaatttttataccattcagcagtagaggagaaaaatatctcttaagaatgaggtgtaagaggtagacagcgctgtattgaggtggtactgccactctgacagcaactgagtatatgaagtttggcaaaattcccatcccaattggggagctaccaagtcatcacacatgcatttctgttggaatcattttatttctaccctaaatgataatagaacatatggatttggggatagcagagatgaaagccatttcttccttgtaagtttccactgagggattgtactcgccaaagaagtacaaatgcattttagatctacaatcatttatcaattatcaaacacctatcaaaatcatagggttggctctatattatgttggaagaataaaaatatgactcgagaacccgggaaggcggagcttgcagtgagccgagatcccgccactgcactccagcctgggcgacagagcgagactccgtctcaaaaaaaaaaaaaaaaaaaaaaaaaaaaaaaaaaaaaaaaaaaaatatgactcgaacaggcccttgaccttggtggactttaagtgagggagaaataaattatcccagatatttgcaatgctagaaagagatgcaaagctaagatgggtaaagaagaagtagtaattaacaccttgaagactatttagcagttctccaagaatataagtagaaaacatacacgagagctctagggatacagaaagggcatgaagttagtgttaaacaggcctaatcctggtttctggagtctgccctttggcagagacttctgtgttccactgaattgtctgttttccttttcttccttaagaaaaaaaaaatctcaattttatttagaataacactgaccactagaagtcaacattttccaaattcctttgcattttggtgtggtcatgtgactaattattgcctgaagagatgtaagcaaaaaggtgatacggaggattcttaaagagctgacagagctgggaagggcctctattctgcttctttcctgctctctggaatgaagatggtcagaactgaagccctggcagtcattcttgagatgagaggccacatgctaaggatagtagagactaaacatagaagtgtagggttcctgatgggtttgtggtatagttacaacaggcctgtatttctcacctatgaaactcttttacctgagagagaaatgatcttcagtctcatatatgtcattttaccttcagtctttgtgtctagcagtgagcaaactcccaactaatatgttctacttatgcagagcatgaggaccttcacacgggcgtccaatacacatacttcctcctctgctcaccatctcacctaatgggaaaatgcctaatatgaaactggagaaagcttagaatgattaaaaaaaaaaaagcattttaagggaggagagagggcatttgaaagggaaatttcaggaggataatccttttattttgtgaaatatatttttcaagtgagaactgaagaatagtcttgacaagtttagagaagatgtaaaacaattcatattgcccctttcttgatgagtcacttggggtaccatcaaggtcacatggaaagattttataagggttagaatcagtccatttttaagactagcctatcttgggcaatagataatagaggtggcctggttatagggcaaggcatgaaaaactagagagaaacttaatggatgacagagtcattcagatgtcattcattatatttaggctcttatgaaggtcagatggaccaggagggtctgatatcctggaagatatcagtttggtattgcaacactaagtaaaaagcaagtttcataagaggatggccagacaatgggctctgggttcaagtgttaaggagtaacggttaaaaatgatgtacacttctgaagaatggactcgcatttaggtagttgaaattttatgaaagaggagtcttaagtttggcaggcttgaggatagccaatgtttaaatagagtacatgtaaaaaatgacctaagagagattatcaggtaccagctcctcattcagacagctttagtcagaagtagtgtggcctgaggataggttgtggtttctacctgactcattaacttatttaataactttatcaggtatacattttatccattgctaaagacacaatgcaaagatgccaagattgagaacctacaagaggggcatgttgctgagaacctgaaagagggtcgtgctgctgagacagtgcataaggatgctccaacagacctcccaatgtgaaatgaaagtgtcaagccatctttaaaaaggtgagaacctctaggactaaaaaaaggacttgtacaagaattttcataatagcctatttgtgaaagcccaaaacatgataggcaaggtgtccatcggcataaacctgataaacagtctatgggatgtccctacaaggaaagctactcagcagtaaaagactagaactattgctatgtgcaccaacaaggatcaatcttgaaaactatgcttagtgaaagaagctctgcctatgttctttcctggtcagtctctaccttgacaccaccagaggcaataactgttctgtgtccttcactcagcgtgatgtttttgagatttatccgtgctaatactctatgactacatgtttgagtagtttattatttttgtattcctgagtggtactgtatcacataaataatccagagatagtttattaattcttctattgatggacatctaggctatttcgagtgttttgctattatgaataaaactgcaatgaactttattgtataagtctttttgtggacatatgttttcatttaccttaagtaaatatctaagagaccttcgagcacaggacaagtcgtatttaatcctgtaggaaaccactagtccttcctcaaatggtgtaccattttactttactttattttttatttagtttttgttgagcatccgttctctcaatcacttatcctttgagttacaaacaatccaattacactgttattttaaaatgtacaaataagttattattgactatagtcacccaattgtactatcaaatagtaggtcttactcattttttctatattttatacccattaattatctccatttacccctaagccccctgtgcccttcccagcctctagtaactatccttatactctctatgttcgtgagtttaattgttttgatttttagatctcacaaataagtgagaacatgaaatatttatctttccatgcctggcttatttcagttaatgtaatgctctccagtaccatccatgttgttgcaaatgactggatctcattattttttattgctgaatagtactccattgtgtatatgtaccacctttttttaatccattcatctgctgataggcacttaggttgcttccaaatgttaactattgtaaacagtgctgcgcacacataagagggcagatatctctttgatatgcttatttcctttcttttggatatatacccagcacagggattcctggactatatggtagttatattttcagttttttgaggaacctccaaactattctccataatggttgtaccaatttacattcccaccaccagtgtacaaaggtttccttttctccacatcctcaccagcatttgttattgcctctctttccaatataagccattttaactggggtgatataatatctcattggaattttgattagcatttctctgatgatcaatgatgttgagcaacttcccatatgcctgtttgccatttgtatgtcttcttttgagaaatgtatattcaaatcttttgcccagattttttcctatagagttgtttgagctccttatatatcccttgtcagatgtatagcttgcagatattttcttccattctgtgggttgtctcttcactttgttgattgtatcatttgctgtgcagaagctttttaaggtaccactttatgctctcaccaccaatgtatgattgctccacatacttagtaatatttagttctgtcaatctttttgacttttgctgttttggcaagtgtgtggtggtatttcgttgtggagaatactattcttaaatgtatgcattaaaatacacagatttataaagaaaaagcagctatcttgaaaaatatccaagtattttaaatacttgaaatacagaattgtgtatgcttttctatcaatatcaaatgacaagatgtagcatgagacctattaattttatatttttgaagctttaaggagcattcatagaatttcaatacagttgacataactgcattgatatgaaactctctgtggtatctattggtgaccaagcgaaggctattgctaccaccactctgttattcataatagaacgaaatgctaaatttcagataggagtcagtaaaaatgaagttggacattttttcactgaaatttacaaacccaaagactcttgtgcacagtctttaaaaacatttattagagaggatgataaaaataggaactcttggtttctatctaattctgagattctaggctgtttgaagcagccaactctaagataaaggcatcgagtgacttggacagaaaagatggctcaggggcaattatcaaggaagaaggttgttcccagaaggcagacagatggcaaggcagaaagaggcaggactaagggaagatggaagagcaacagcagagatgatgaaggagacaaatctcatgctctaacatagtggtttgccaccatatctgttctttagaatcatctatgacaattttgaaaaatgaaaataagtgtcttggttttactcctagagatttgatccaataatgttggtggggcctggaaaatagcattttaaaaaaagtcattggtagcttaaaggaacattggtggttgagaaccattactgtaaataggaagtttgtgctacggtgcaactgacatgtttgggcgtgaggaacaaaactggtggaacagaaggttagtggagttaaggctgggaagcagatgggtgatagggatggagccagcaagaaactgggagacaggataggaggatgtgcgaggcttatgtgctgtcaggcaggattcttcatagccttaggcagaattcaatctagctgggcactcaagggaggggctgctatcatcttttgttatttgtatgaatagtggtatgagctttacaacaattctaggaggtcaggttagagtgtgagtgccaatggctcacaggttcccaaaggcactggggcagagataaaatcgatcacaatttcagcccatgcgagaaacacttccataaatcacttggtagatgatgaaaacaaataatacgttccatgatgcattcactcttctttgagttgtccatatgttgggttcacgtgacagcaggttgaaggtgacatgagttcagattaagccagacaccattatacatgtctgtgactgaacagccctttctctgttcttgtattcacatttcaattggtcttcttgttcacttctcaaaatattgtagtaatgtagtagaaattaaaagagcttaacatatacttgaactcagtctgctatgttgaaatgagatggcagctgatggagattttaaatagacagagctttcatctctcctttcctcatttatactcagtgccaggtgctaataacgccagtgttcagaagcatccagtttccaatagtggtatctagatttttgtcttcttgttctgtgtcttagttttttggttttttttttaaaattgttgttgctgttgttattgttgtttgcctgaatgtttttgtagaaaccaaaggcatctctgccaactgaactcaataaaaacatacccccatgacaccagattggcctctgaacattgaagcagattaaacattttgctacactctcttatatagtttaaggtcaatggcatgcatatatgttcagttggccctatcttctataatatttaattatattattataaatatagtaagtattataatttttattataatttttaattatagaagatagggccaactgaacatatattttaatataatttggtttgtatagggaaaacttagagataaatgaagataacataaaataatgatagaacgttttgtaataaacagatcagaaaaggtctacatatgagaacattattctcaaaacagtcttcctgagaaactaattatataagactgccattgttcaatagacacctggaactcctttctaggaactgcctctggagctatttggttggttataaattgggctcaggaggcatatggggcctaccatgtgtgctttcttagattcacatggccatatctgcctgccaagctcccagatgcttgcttggtaggaagctccagctgccaccatcagtggcagtgctatcagcctccgcctccgcaggaataagggtggggctcttataagatttcaactgagccttccacagtgagagcctcaggccaagagaaccaataagatagagactatgtcttctctctccacttccaggccaagatgcagtctccaccattgagcataggagtttgctttctctacatccagaggaactaggtgacacaactctggggtatgggagtgttactgcctcgtgggaaaaacttaactaaaaagacacaggagacaggagggagtaacagataattccagatcccttctttctctgttggactattccaaggtgtggccattctttatggcatgtccaggaaaaccctgtatttatcagcaatcagagatgttttcttataaagtggtggccagtttattaaagtataaataccatgtatttgcctttattccttgcccttcccttattcctttgtgcttactgtcttgtgattgcacctcccaaacattagcacataaacttcatgttagttgttttccagggagcctggtccaagactctagactactgaattctcttatttataagactcactcaactcaaagaacaacatttccttggcattgaagagagcaaggagaatatgccagatatgctaaaataaaagtccacagtgtagtttcataatagaaacagtactgaaagcaagatttgtccatctcatgtgttggaaagaagaccacataattttggagttgcatgctctgatctgtttatttacaacaaacaaacaaagatacaaataatctgcaaatttttatctaaaacaatctctcattttcttattctgttagcccaattttccttcatagctcttatgaatatctggtattatattatcttatctctccttgtctcttattcatttactagaatgaaaatccatgtagaggtcttatctgtcatgtttacagattaattcctagcatcttgaacagaagacctaccatctttgaatggcaaggtcagaagaaatttaaaatatttatcttggctgggagtggtggctaatgcctgtaatcctagcactttgggaggccgagatgggcggatcacttgaggtcaggagtttgaaaccagcttggccatcatggtgaaaccccgtctctatcaaaaatacaaaaaacttatctgggcatggtggtgcgtgcctgtaatcccagctactttggtgactgaggaagaattgcttgaacctgggaggcagaggttgcagtgagccgagatcgtgccaccgcacttcagcctggatgacagagtgagactccatctcaaaaaaaaaacaaaattattttaagcattcatttattgattgatttattgattcatggatttaatagacatttattgaatactcatgcaagcggacatgtttcctaaaattccttctacagtaacactacaaaagtgtctgggtatattccttgcacatatttcctgtgactgagagctcactaacctgaacagtatgatgttctggtttcaagcagagctgatattcagttaatgtgcacctaaaaaaaatgaactagttggtaatatagtgaaatgctttcaggtaaataaatagtaaactagtaactgtgagaaactatataattaatttctaatataatttctaatatgcactccttagttcaagttaattgtcaaataggcgtcacaatgacaataattaaatagattttctgacattgagtaatttgactgagtatggatattattgaataaaagagtatctcagaccatgttagaagggttagaaaactttgaaagtaattattagttcagcagaagctgcaagaggcttctacaccatgaatagcctaattttgataaatagaacttgtctatttagtgatcctaaatgtatctaatgatgtcatgacagtagtggccacaacagtatcagttcctgacagcagtgtggacacaggttctgagaaccccatacaacagctgactagataatgtgacattggtgtgaggatgtgtgacccagaccactgctttagagtgacccagagttggctgtgaaattgcaaggaggcatcaaggggcaggcactccagatcctgagtcatgtggaaagtgttgagtcatatggaaagtgctgacatccaggggtgggcctgggtgtaccacgaggtcagtactcagctgccctctggatgcaataaagcctggacatcaataacctaatgattcttgacttcatgggagtcagtggacctgctttacaccatttctatgtcaaaccatggctcacataaggacgtcatttagttagagacccatatccgaaaaaagaccactccggaaatttttaaaaattaacatgtgatttggaaattgttctaatgtttcataaacgttgaacatcatgactcgtatgaatgattatgatgttcagttagtagagtactaaaaattctacctatgcttttgtcagtgttgtaatttcactaatactttttattactatggcaatgctttttaaagttgtttaagactcataataagttgcaaaaatagtgcaaaattcctgtgtaccctttactcaccttcctccattaataatatcacacataaccacagtacagtgtcaaaatgaggaaattaacatagtatcatactgttaacttgattacagaatttgtccagattttaccaggacttacgtgtactcttgtgcgtacatgtatgcgtgtgtgtgtggtttacctctatttttaaggactgtctttccttacaatctctatgccaaggtcatggagttttagccattgctaggcagaggtggagctatacatgactgcgcccccacataatcacattcctttcatttaagaatattcatcccatatggagaaatagaccatgtttattaatcactccagaaagtatgtaatttcattagatcaagctctgtctctgggcattgactaatagagggaacggctccccagcgacccagaacccctacgacacggtctgtggagaccatactttggggccagctgctcaaatgcactgctggaattccaggcagaaatgtgtaatggcatgccaagggctgctgagctgtcatagtccaagcagggttatttgtggcttccaaagagaggctgtaaccttttatggtatccacaaatctcagccttcaagagtcagggagaaaatgcaaccatgctgtttgaccgagctaactctttccccaccttgcccctctcccactcccaccatcactctacccccaaccctgagtagtctgcatagctgtcccagggcaaagaacatggcatgagacattacctttagcattacctcagggccagataaaatggccaggcatcccttctgattcaatgagggaaagtcccagaaagttgttgacaaagtagaaactttctaatttgaggtcctgaacattcattgttctttctgagcaagacagaaaagttttacttattggctggggtacttttaatggcagctgtaggccagggacagtcatgtctacacatgtactctcttatcattgatcaggcccattagaatgccagagctaaagaatatctctcctttgctttgcaggcacatggagaagggtttcctgttgtcccttttgacataaacacagtgcttgaagtatcttttctggcaacttctctgatccacttgtatgtgtattcacttatttcattcaccaggagagtcaaatgagtgaaatggttacaaatggtggctctggaatcagacagacttgggtttcaatactacctctaacacttattggctgtgtggccttcatattaggatagaaagttcacatgttgaacttctaatccccagtacttagaatgtgactttatttggagatagggtctttacagttgtgccctttacagttgttcctaagaacacctaagattggtgtccttaggaaggggtgacattggagacaggtacatataggaagaacaccataataacgcgaactcagagattggggcaatgcttttacaagccaaggaatgccaaagattgtccaaaaatcactggaagctaggaaagaggcccagaacagatcttccccttactaccctcacatggtgccaagccctctgaccttgatcttggacttctagcctccaggactgtgagaaaataaatttctgttgtttaagtcaccacttagtatgtggttctttgttacagcagtcctagcaagccaatatggctagttacccaactttctagaaattcaattttcttattcctcaaatgcaatgactttagcagtgattctcaaagtgtggtccttggacaagcagcatcagcattatccagaaacatgttagaaatgcaaattcataggttcccaccctagatttcctgactcagaaatccttggggtggggctcagaagtctgtttaaaccagctctccggatgattctgatgcatgcttaagtgtgaaaacttacgatattgtagaaaggattctatcaaacaatatatgcaaagttcttagcatagtgcctgacatacagtaagatatgacaaaccacaagacattttcaaacacttatataacacttaaggtggttcagcatatggaggtgtaaagatctataaattttgatttctcaataaactggcagaactcacaactttgggaaaggcatatttgcaacaattaacaaaatgctcttaggtgttatgatattgttccagatgtattttgggaagacagtagacataatggggcagtggaaaatcagggcagaaggtatcaatagatagacaaatgatagctagatatgtttacagatgattgatagagagacataagcataggaggcaacaaaatatgatttatttttattagaataatgtttgctacacaattcttttttctttaaacttgtatttctggctgggcacggtgactcacacctgtaatcccagcactttgggaggctgaggcgggcagatcacaagatcaggagatcgagaccatcctggctaacacggtgaaaccatctctactaaaaatacaaaaaaataaaaaataagccgagcatagtggtgggtgcctgtagtcccagctactcgctactcgctactcgggaggctgaggcagggcaatggcgtgaacctgggaggcagagttttcagtgagccgagattgcaccactgcactctagcctgggcgacagagagagactcccatctcaaaaaaaagaaaaaaacaaaaacaaaaaaaaatatgtatttctaaattgattctcacaacagatctgtgggaaaaaacactataaggagaataaaaataacacccagctattagggaaatactatcaatatttaacatattattgttaggaagattaaattataccatgcatgtaatatgttcagaacagaggtaggcacatagtttgccctcacgaaatcaaacctcattatcattattattattacattgttttcattgttcaaatatagaatgaaatttcagaggggacatcactggttaaataaagatccttgtttcaagtcctgtactaatggtttccatccttggctatttccgctgtgttgtgccatctctcacatgagatattgtaagcttctcttagccccatcacagtcctatgattgccctactaaaatgtctgcccctgaaacttgtggatccttttcaaacactatactgggatatcccacctcattgctcagtggcagcctgttctgatgtccagtgtccaaaaaaacagaaggtcaagccctacggttatgaaacagagacactgggagaaatctagattccatgcaagggtgacactgaccaaatgtagtcttttctctatggcgtaaatgctaagaatgagagagtgagttacttaggtgttgggagcaagccccccaaaatctggccataaactggccccaaaactggccataaacaaaatctctgcagcactgtgacatgttcatgatggccataaagcttatgctggaaggttgtgggtttaccccacaatgagggcaaggaacacctggcccgcccagggcagaaaactgcttaaaggcattcttaagccataaacaatagcgtgagtgatctttgccttaaggacatgctcctgctgcagttaactagcccaacctgttcctttaattcggcccatcccttcatttcccataagggatacttttagttaatctaatatctatagaaacaatgctaatgactggcttgctgttaataaatacgtgggtaaatctctgtttggggctctcagctctgaaggctgtgagacccctgatttcccacttcacacatctatatttctgtgtgtgtgtgtgtgtctttaattcctctagcgctgctgggttagggtctcccctaccgagctggtctcagcaagtggctccattcatggggactcaaatccaggtcaaagggttgtcagagcaatagtgggaacagaaaactagctggaggacacccgagtactcttaaagcaatccccgtggtgagtaggaaggggagctcagaagcatcagggtaacaatgggacaggtgtggggtctggttcatttcaccttggatctttttcacactgatgatgaggaggaacgagagtacagtgaagtaatagaagaggttacagagcatgtttatttgccagctaaagctaaagtggcaaaggagggagaggtgcatccctacccttctgcaccccctcattattattttgaagaaaaagaccctccagatctttcttttccagaggacactgggcaaaaagtagttgtcccagtgactgtttaagcagcgcctcgagtgactgctcttagctctattcaggcaggaattcagcaagctagatgagagggttatttacaggcttggcagttccctgttagaatacaccccccagatcaaaagggaaatattatagctacatttgagccttttccttttaaattactcaaagaatttaaacaagctataaatcagtatggaccaggttctccttttgtaatgggactgttaaagaatgttgctgtttccagtcggatgattcctactgactgggacgctcttacttgagcttgtctaactcctgctccattcttacaattaaagtataaaaacaaacaaacaaacaaaaaacaaaaacaaaaacaaaaaaacttggtggggagatgaagcttccattcaggctgcttgcaatgcccaggcccaacctcaaattaatgtaactgcagaccaactttttggggttggtggatgggctggtttagatgcacaactggtcatacaggatgatgccatagaacagcttagaggagtgtgcattagagcttgggaaaaaatcacttcaggtggagaacaatacccttcctttagtgctataaaacagggaccaaaagaaccatacattgattttatagctcggttacaggagtctcttaaaaagatgattgcagattcggctgctcaggatatagtgttgcagttattagctttcgacaatgctaatcccgattgccaggctgctctgcgacctatcagagggaaagcacatttagttgattgtatcaaggcctgtgatgatattggaggtaatctgcataaagctactctgctagtacaggccatggcaggactgagagtggataagggaaatactccatttcctggagcttgttttaactgtgggaagcatggtcatactaaaaaagaatgtagaaaaattctgcgagtcaggccaccagataggggaaaaaaaagaaaactgttgagcctgaaatatgtccaaaatgtaaaaaaggaaaacactgggctagtcagtgtcactctaagtttgataaagatgggaacccgatttcgggaaatgccacgaggggcctgtcccgggccccattctaaactggggcatttccagctcaggccattccctcacccctgtacaatgtctgtcccccaccacagccagtagtgccgcagtagatttatgctgcacaaaagctgtgagccttctgcctggggaacccccgcaaaagatcccaacaggagtctgtggatccttgccagcagggacaataggattacttttaggaaagtctactttaagtttaaaaggcatacaaatacatacaggagtcattgattcagattataatggggaaattcaaattgttatatctacttctgttccctggaaagcagagccaggagagcgcatagcacagctcctgactgtgcaatgtgtgggaataggaaaaagtgaaattaaatgaacaagaggatttggaagcacaaataaacaaggcaaagcagcttattgggtaaatcaaattactgataaacgtcttacctgtgacataactatgcagggaaagaaatttaaaggtttggtagatacaggagtggacatttcaatcatttctctacagcactggccatccgcgtggccaattcaacctgctcaatttaacatagttggaattggtaaagcccctgaagtgggatcaaagtagttatattttgcattgcgaagggcccgatgggcaatctgggactattcaaccaattataacttctgtacctacaaatttatggggaagagatttattacaacaatggggagcacaagttctaattccagaacaattatatagccctcaaagtcaacatacaatgcatgaaatggggtatgtccctgttatgggactagaaaaaatttgcaaggtttaaaaagttcctgccaaagattaggatatcatttttgatggcagccattgttaagcctccagaacctatacctttaaaatggttagcagataagctaatttggatagagcaatggccgctaagtaaagagaaactggaggctttaggtattagttactgaacaatcagaaaatgggcacatagctccaacattttccccttggaattctccagtttttgtaattaagaaaaaaatcaggtaaatggagaatgttaactgacctaagagccatcagttcagttatacaacctatgggagtattacagccaggattgccttctcctgctataattccaaaaaattggcctttaatagtcatagatttaaaagactgtttctttactacccctttagctgagcaaaattgtaaatggtttgcatttacaattcctgcagtaaacaacctgcagcctgctaagcgttttcattgttttacagatgggtctagtaatggtaaagcttcttattttggctcaaaaagtaaagttttccagacatcctatacttcagctcaaaaagcagagcttgtagcggtaattgaggtattgactgcttttgatatgcctattaatgtgatttctgattcttcatacatggtttattccacacagttaattgaaaatgctcagttacgatttcatacagatgaacaactgatgactttatttacccaattgcaaacagcatttaggagtacaatgcatcctttttacatcactcacattagggctcatacacctcttccaggacctttgactgaagggaatcaaatggccgatcgcctagttgctaatgcaatatctaatgctagacactttcacaatttaacccatgttaatgcctctggtctcaaacgcagatacaacattacctggaaagaagctaaagctattatccagtgatgcccaacttgccaaatggtacattcctcatcttttacaggaggagttaatcctcaaggattggaacctaactgtctttggcaaatggatgtcacacatgttccttcatttgggagactagcttatgtacatgtatgtgtggacaccttttctcactttgtctgggctacatgccaaacaggagagtcttctgccagtgttaaacatcaccttttgcagtgttttgcggtgaagggcattccagcttctattaaaacagatgatgccccaggttatgctagccaagccctagctacatttttctctatgtagaatattaaacacattactggtatcccatacaattctcaaggaccagccatagtagaaagaatgaatctctccctaaaacagcagttgcaacagcagaaaaggggagacagagagtatgggaccccacagatacaactgaacctagcattattaactttaaattttttgagcctgcccaaaggatagatgttatcagcagctgaacagcatctacagaaaccagctgcaaagacagaagcagaacaactgatttggtggagagatctgattacaaaaacttaggaaataggtaaaataataacttggggtagaggttatgcttgtatttctccaggcaaaaatcaacagctgatttggataccaccaagacacctgaaaccttattatgagccagatgccaaggaagagattccgggaggatcccgagtactccccggttgcagccatgtcaagactgatgctgaggaggaccccaactgtcacaaacaacacatgtcaaacacagccactcatctggggacagatcaagaagctgccacagatggcggaagaaaacctgaggaaagtgggacaaccagtcacaacaagtaatttaatggtagctatgatagcagttatcaccgctgctgtgagtattccttcaataaggactgacacagagaacgattatacttattgggtatatttatcaatcttggctggcaacaatgcctggatgcaatcactctatgtcacagttacacatgctttctgatctcagtatttaccataataaatctgctcctataattgaggcataccgccctcaaaaacctatttgtaaacaggattggacccagttagaaaaaatgaacgtacttgtttaggaagattgcattgcagaacaggcagaggtgctgcacaacaattcctatggaatcattattaactggtcccctaaggggatgtttagcttgaattgctcctctcagtccgcgtcccacggtcatgctatgttcagataatctgaacaaaacggtcagatggtagaaataatagaagtatggcaagagttcctattatctggaaccatgtcggtatagtggcacctcaacctcaaatgatatggcccactctaggagcttaacataaggatttgtggaaactattaaatgcacttaatgagatcaaaatttggaaaagaataaaaaagcatctagaaggacactctacaaacttgtctttggatattgcaaaattaaagaacaaatatttaaagtatcccaggcacacctgaccttaatgccaggaactggagtccttaaaggagctgcagacagattagcagccagtaacccaataaaaacacttggaagctctgtgatttcaatgatgattgtgcttttaatctatgttgtttgtctttatgtagtctgcagatgtggatcctgactcctgcaagaagtagctcaccatgacaaagctgcccttgcttttattgatttgcaaatcaaataagggggacatgttgggagcaagccccccaaaatctggccataaactggccccaaaactggccataaacaaaatctctgcagcactgtgacatgttcatgatggccataaagcttatgctggaaggttgtgggtttacctcacaatgagggcaaggaacacctggcccgcccagggcagaaaactgcttaaaggcattcttaagccacaaacaatagcatgagtgatctgtgccttaaggacatgctcctgctgcagttaactagcccaacctgttcctttaattcggcccatcccttcatttcccataaaggatacttttagttaatttaatatctatagaaacaatgctaatgactggcttgctgttaataaatatgtgggtaaatctctgttcggggctctcagctctgaaggctgtgagacccctgatctcccagttcacacctctgtatttctgtgtgtgtgtctttaattcctctagtgccgctgagttagggtatccctaaccaagctggtttcgacatttagggaacctggtcatggctgggtatggcatgaccatgagctttgaaggggtgtaaaaacctagcacttattcttacctcttttgggtctttgaacctatatttatggtaatgctggctagtgttaacagatacattatctgtgttctatcatggtatatgtatatgtcccatccacatcaagttaaattggtgaagaggtctgcatctagttactaagcatcccaggctgccatgggattttatgatttttaggatgtggattccaagggtgctctgtgtgtgaatattcacccaccagatgaagaaagagaaggatagataacctcataggagttttataggctaagctgaaagagatctgcattaatggcctaaattttattaacgagaactggaagcacctaattgctaaggaaggtgagggatgtaatctacccgtgtgcctaagaagaaagggagctagatttcaggaatgcttagcagcctttgccgtagacctcattgagaaaggaaagaaagaccctatatccacccactacccatccccccaaaatatacaaacagcaagacatatgagaaaaatgctggtcattttggagttttacatcatccttcaagccacagtccctaggataaaaaccactgatattccagtttcttagagaaaaggatcagatcctaagtgatggatatttgccaacatcatttgaaagcctctttagccataagcagtacttagttgcagagactgagaattcatctttgggaagataagggagggaattgctactggcatcacctacatatggctgccacctgctcagcatctccagggcttacccagggatatcattgctataaggatacttgaaaaggtgaaaacaactttggaactggataacaggcagaggttggaagagtttggagagctcagaagacatgaagatgagagaaagtttggaacttcttagagactcgttaaatgattgtgaccaaaatgctgaaagtgatatggacagtggagtccaggctgatgaggtctcagatggaaatgaggaacttactggggactagagcaaatgtcacgtgttatgccatagcaaataacttggctataaagtgcccttgctctaggaatctttgtaagtttgaactttatattggtgagttaggttatctggcagaagaaatttctaagtagcaaagtgttcaagacttgacctggctgcttctaacaacttatgctcatatgtgggagtgaatgaatgatctaaagttggaacttaaaagggaagcagagcacaaaagtttggaagatttgaagcctggacatgtggcagagaaagaaaaagatttttcaggagaggaattcaagcaggctgtggagcaaccacttggtagataaatttccataactaacagggagccaagtatggatagccaagacaagggaaaaagacactgaaggcatttcagagaccttcagtgaagccattcccaacacaggcagagaggcctcttggaaggaagaagggtttcatgggtttggtccagggccctgctgccctgtgcagccttgggacattgttccccacatccaggctgttctagctccagccttgtctcagaggacccctggtactgctctggccactgtttcagaaggcacaagccaaaagcctggaagctcccatgtgtcgttaagcctatgagtgcacagagtgcaagaatgagtgaggcttgggaacttctgcctagatttcagaggatgtatgggaaagcctgagtgcccaggcaaaagcctactacagaaaacctcgcaaaaaacctctaccagggcagtgtggagggggaaatgtagggttagaacccccacacaaagtccccactggggcactgcctggtggagctgtgggaagggagtcactgacctccagaccccagaatggtagatacactggtagcttgcaccctacacatgaaaaagctgcaggcactaagcaacccgtgagagcagtcaaccggagtggagctgtccagggctttgggaatgcaccccttgtacctctgtgctgtgcatgtgggaaatgtagtcaaagagcttattttggaactttaagatttaatgattgccctgttggattttgaacttgtgtggggcctgtagcccctttctttttgacctatgtctcccttttggaatgggaatatttacctagtgattatacttgcatgataaaatatcctaggagtcaaataacttgtttttgattttagaggttcatagatggaaaggacttgcctcatctcaaatgagactttggacttttgagttaatgctggaatgagttaagactttggaggactgttgagaaggcataattatactttgcaatgtaagaaggacatgagatttgggaggggccagggatggaataatataatgtgaatatttgttaccacccaaatctcattatggaattataatcctagtgatggtggggcctggtgggagatgtttggataatgggggaaggtccctcatggtttggtgctgtctttgtgatagtgagttctcatgagatcgaataatttcaaatgtgtggcccctcccctgtctctctctctctctcccccaccccccacttgctcctgcttttttcatgtgacttgcgtgctccctcatcatcttttgccacaactgtaagtttcctgaggccttccaagaaattgagcagatgccagcgctatgcttcctgtaaagcctacaaaactgtgagccaattaaacctctttttttaaataaattactcagtctctcgtatttctttatattgtagtaatgcaaaaatggcctaacacttttatgttttcacttcatttgtgtagttaattggttgtaaggtaagcatgtagtttaatttacaggaaaatatccaaatattttccaaagcaggcatataatttctcatcccagtaatcaaaacgtaagttctagtaactgtatctttgccaagatttagtattgtctttcttctcctgcctccatattctcagaggtatgtagtggtatctcattatggttttaatttgcattatcctaatgattaataatatagagcatcattgcacacttacttgccatttgcatatcatcgttggttaaatatcagcctaaatcttttgctcacttaaaaatttgttatctttttaaagagttctttatatattctggatacaagtaccttattagattaatgtgtttgaaagtatcttctcctattttgtggcttgtttttcattattgtaacagggtcttatgaagagcagaagttcttatttttaattaaagtcctatttatcattttttccttttaatggctgtgcttttagtgttgtatctaaaatgtctttgcctaactcaatatcacaaagattatctcctatttttttcctagaagttctatgagtagaggttttaggtttacatctataatatattctcaattaattttttgccggtggtgcaaagtatggattacaatttatatatttttggatatgatgcaatttttccatgggtgcgttacctttttcattttgttagttttgtacctttgtttaaaaacatcaattgtcaatatatgtatgggtcttggtctgacttacttgtgatccattaatttatgagtatattatttcattgataatacaatgtcctggttattgtagctttatagtaagtcttaaaattagcctgtatgagtactgcaattttgaccttttttctaaaattattttggttattatattctctttgcattaccatgtaaattttagaatcatcttgtcaatttttacaaaataccttgctgtgattttgattgagattgtactgaatataaagattgtgagatgggcaattgacatcttaataccactgagtcatccagtctattaacataataggtctcatttatataggtattctttgacttctttggtcagtattttgtagtttccagtgtacagatcttgtatatattttgtcagctttaacctcaattttttatgttttagggacattttttcttttttcaactttaatttctaattttaattcccaaatgttcatcgctgcaatacagaaacataattgatttttgtacatttaatttgaccatgaaaacttgctaaactcatttattagttttggtatgttttatgtagcatatttgggattttctgagtagacaaacatactgtctgaaaatatgacagttttatctgtttcttaccaaaatttatagtttctattttttcttgtgctctagtgtgaatttgaataggagtggagaaagcatgcatccttgtcttttgcctaattttagtggaaaaactataggtatttgtagcctctctaaattatgttgagaaggtttccatttggttttagtttgctgagttaaaaaaaatcaattatagattttgaatatgtggaaaactttttcctgcttatattaagaaactcatattgttttccttatttaatctgttcatataataaatttcatcatttctgtgatgagccttactcggttgttttgtattatctcctttttatattgccagattctacgtgtaatttttttgaggatttttaaatgtatgttcacaagaaatgtttttctgtgattttcctttcttagaatgcttttgtatggctttggtagtattagggtaatgctggcctcataaaatgaattggggagtgttatctccacttctattttctaaaagagatttgtggaattggcattatttattctttaagtgtttgatagaattttccagtgaaatcatctggtcctaaagttttctttcttggaagatttatagttattaattaattatttcaattgatttaggactattcagtttatctatttctcctggaatgaactttagtagtttgtatcttttaacgaattttaccatttcatttatttatagacataagttgtttttaatattcccacattattttatatgtagaatttatactgatatcccttttatattccttatatttgtcttttgcatcttctctttttttgtttttatttaacttctggccagaaatttatcgattttattgactttcgcacagtcagcttttggtttaattaattttctttattgtttttggtttgcaattgcattagtttctgctcttatatagtcagtaaaaatttaataaaattttatttccactgatttatattcttttgcttttttcaacactgatttacattaaaaactccaagcacactataactgaggggaacttccttgacataatgcatctacaaaaatgctaaagccaatattatacttaatggtgaaaaattgggtgcttcctccaatttctcaagaagtcaagaagtaggcaaggatatcctttctcaccattcctattcaatgtgatactcaaaattctagctagtgcaataagataagaaaaggaaataagtatccgcagattggaaatgaaaacataaaatggtttgaagatgacatggttgtctgtacagaaaatccaaaggatttgacaaataaactcctggaacagataaatgattatagtgaggttttaggatataaggcatattagtttctagggcttctttaacaaattaccacaaactgcatggctaaaaaaaacagaaatttgttttcctattattgtgaaggctaggagcctgaaatcaaggtgttggcagtgctgtgttctctccaaacacttcaaagaagattccttctttgactcttcctagcttcttgtggttacaaacaattcttgacactccttgatttatagatgcatctctccattttttgcctccagtcttcacatgatgctcttctctggtgtgactgtttcttcacctggctttcttataacaggtaccagtaattggatgtacagctcatcctaatccagtgtgaacacatcgtaacttaactaattacatctgaaaatacctattttcaaataaggtgacatccacaggtaccagggctaggacttgaacatatctttttgaagaaattcacagtaggactccccaaattcatgtccttctcatgtgcaaaatacactcaccctgtcccaacatctcccaaagtcctaacccatttcaacatcaattcaaagtccaaaatctcataaaatattctcaactaaaaatgttccaaatctcaccatgaaaatcatccacatttggtatgatctgagtatgatccatcctggggcactattcttttttatctgtgggcctgtgaaactggaaaacaagccatttcatttcaaatacagtagtgagagagacacatgatagacattcccatttcaaaggaagacattggaagaaataaaggggtcacaagtttcaaggaagtccaaagcctattagaaaaaaatctattagactgtaaagttggagaatcattttctttgactttattctgtgtcctataggctgagggcaggtagagctcttttcttagcagccggggaagcaactccatcctctaggctctgggcttccagagactgttggcaccagctccactcttttggcccccagctagataaaagtagccagtctgaaaagcctacatagtatataatgctaattatacaacattctggaaaatataagattatagaggctgtaaagggatcaaggaaaagggagaaataaatatgtgaagcataggaaaattttagggcaaagaaattattatttataatcctgcaataaggcctgttttcaaaattgatagaattttacagcacaaagaaagaaccttaatatatgcaatttaaaaattatttagtaagttggaggattccacaaagaaatgcagactatggctagagaatctaactgtactacaaaagcaggaggctgataaattattcatttttgtaactttagaaatgagtggagttggtaagactaacggcaaatgtagctgcacataagcattgtactctagttcatagaggtctttcccacacgggtatgtcttagcaattctagtactgccatacatcttaatactgctatacttaatagtggaactagtaagtaataagtggaagatgatggagccaggtttctgactgttggagtggaaatttacagattagaaagggaaggaggctagaataatctatgtgataatggattagcattagaaacaacagtaatatagaatagatgattttatatatataaattattcatagatacgtgtatatacaccatttacacacacacacacacccctacacctttttctctgtcagctgatagagcctaagaaaagtaacacctcagtggcaatgagctcccaagcacctaaatcttgatttctaataccattccctgctctctgccctaaaaaaaaaacaccaaaattctttggaaaaatggctgattctagaactgagacagggaatatacaagatgagcctggagcaacttgtaatgccagaaactggaagtactcaacgaacaagcaaacaaaccccacattgatgggagtatgcaacaaacaaacaaacaaacacaaaaaacaaataaacaacaagacaaaacacagaagctaactgaaagagctaccaatggtcaatgctaaagcaaattgagaaaaaaagaagttgtattagattctaacccaaagtataaaataagtatctgagtctatactgatatgaatacgtggttgagtaaattattgagtaaataaatgcaggagaatagacaaatctctcatgtagaagaatcccaaataattcacatagatactccaccctctggaaagtgaagggcttgaatgcttaaaaatccatacattgaaatccgaacccccagtacttcaaaatgtgaattgatttgaagatagggtttttacagaggcaatcaagttaaaatgaggtcattagtgtgggtcctaatctgaaatgaccagtaccttataagaagaagaaattttaacacagacatagacaaaaaagaagacaatctgaagacacagggagaagaagataatctacaagtcaaggagagaagcctgtagcaggcatttcccttacatctctcagagggaaacaaccctgctgtcagcttgatcttttagcttccagaactgtgaggaaaaacattctgttaagtcacccagtctgtggtcctttgtaaaagcagctttagcacaggaatgcaaggtggaagatctgggtggaatttattttctttctgacaacagtggatccttcctttactggcaaggcctgtgctacaaaggatggtttctggagtatcctgcctgcctcattctttcctgttaacatgcagtaaggcctttgcaaaataccccatgagtcagtgcaaactgccttcatgtatactgctcatatataccagttttctgtactctcatactagttctcagttttgagcagttacttgttaaaaattttagcaatttgttgaaaaaaattagcttcttaccccgcttgtatggcagccctgttttcctcacatgctctgtcccagaaaaaaaaaatgacatgttttatctctccttggaggcacctgaaatttcaaactagttgattgctctgtgaccccagatctttgatatattcaggaaaaaatcataattatgtaaagtatccaatttttttttttggtttgtaaactgggagcaatcctcttttcataacctaagaagaagccagaaatgtctgcatttcaacaaccattagagatttcgttcttccaagaatgcctttcttctaatctgtttcctggtgtaaagtacccagcttttaatagatgcttaattaacaatttataatattagcattcttatgcttatcacctatgatgtctccccaacatgtctggggccagggcatgaattccacaaggaaatcattgacttccagatcaatgacatcttttccagaaatctgcattacagccatgaagttcatgccaacagagctcctgggaagacatacccattggccacattttaagagccagcaaacacattatttgccaagcacacaaacccactataactgatgagggtgatggtttggagcatgagctataacgttggggagatgtggttagtcttgacccctacctctgcctcttgtgaattacatgacctcagacaaatcctgtaaccccctgtgctcagtttctttataaaattgtgctgataatgatggtatccaacccctatgcctggctcatcataggtgattcagagctactagctatttatttagtcattttatcttaaaatcttggcacattgttgcctggatgtcattgtctccagtgcatggagtggccagacccctggccctgccttttctctttttccctgggcagatggagctggttttcctttctggcacacactccacagaggaacttgggaaaggaacaaagactgaagaacaaatcagcctattttccactttttaaaagtagctctgtcagaaggttgagtggaggaggagtttgcagccattggctaaagagggggttctctttcctgtctgtagctttccattcattctcctgtccattacaccacgctggccttgctagtccagggacatcggccccccccacctccagtggtctctcccctgtgtcaatgactcagtttttgcctagagttcccacagctctagggaagagaggtgaggctggagtaaggcaaagccagaggggagcctgaccctgggggcgggggttggtggggcagaggggggcgtcctgcagttgcagttgatgagtgagttcttggtcctgacaggacagatgaggccctttgttcctgcaaatgggcctttcctggcagtgatggagatcgcctgcagtccagcccgctcctcctcttcagctgcagccattatcctaaagtggttttattgatctgctgactccctgtctcctgcctgctctccctttcctcctcccttccccaccccctgcaccccatcctcaagctcctaaatgctctgttgctggcctcatccatgcaaggctgttttttcaggggtgaaggatgattttgaagttagattagacaactgcacttgcctcatgagaaagcagatattcccttagggcaagcattttcagactagcaaaggatatacctccatttaccaaccacaccttttctggatgtagttctttggttgttttgactttttgtaagatgtaggaaatatagatgctatgaaagttcagtttcaaagtttgcaccttggcaaactatagtacattttacaatgtcatgataatgccgcattttaaacaattaccagtcatattcatcttaatacaatttacatgtaattaaagaaatttttaaatcatttagcatttttgcttaagacttagttataagctccataaagttatgtattcttattttatttataacaaccctgtaagataactgtcataatccttatttacaggtgtagaaaaataaatgacttgaaagtcgtaaatctaacaaataccatagacaggactcaaagctaagcccattggacataaaaacttctttgtatttatatgaaagtctgtatttttgatgctgcttaaaatgttaggcacacatctgattaaaaagctgtgctctattacaggtgtgttatgttcgatattacccatgaaactctagcagtcttcattgttaaagagggagtgacccaggtgttaaattacctgagagctggcccatgatcgtcatactatgagcatagtcatacatgctcaggagaatttttaactgagatgtccccatttagctctcgtgtggcttttacagttgtttaaaacattttgagagaatttggagctggtgttcctcaataaaaacatgaaacctggaaagtaatttaagcctctacccaaagttcatgaataaaacttactaagaatctttcttggctaggtgtggtggcttacgctggtaatcccagcactttgggagggattacctgaggtcaggagttcgagaccagccttgccaacatggtgaaaccccatttctactaaaagtacaaaaattagcccggcatgatggtaggcgcctgtaatcccagctacttgggaggctgaggcaggagaattgcttgaacccgggaggcagaggttgcagtgagccaagactgtgccattgcactccagcctggacaacaagagcaaaactcagtctcaaaaacaaacaaaaaaacaatcaaaaacaaaagaaaacaacaacaaacccaaaaacaaaaacactttcctcctagtgagatatgggaccagaacacagatgtggaaacccatgggttcttatacctgaacacttggtgtcagcgtaggtcagtagcaacaatacagagttaagaggcaccagaaaccaagatgctgtcatgacctttaattaaacttacgatcatcttatgtgcctgtatgaaaggcacatttaggagagatgtatgtaccttccatgggcctagaatgaattactgccttgttagaataagagtgaggggaggtctctggaagaatcagattctggttattagtggaggcagtagaatagagcatcagtgagacaatccctatacataattattatttattactattgaacaatactatctgctgtgcaccaatccggttcactgccatatataacattgacatgctcttggccctgccaaatcaataccttctgttgcagactatagagatgacttttgtcctttatctgcccccacaccccattttcaaagtgggagatgtttagaacaagatataattttcactatctctattttaaggctagcacctggagatgctccttgctgtacagtaaagtgtgactgtattttgttttccattgacttacattataaaattggtaatgtgttttcattagaaaaagaatatcataattttaattgaatatttgatatggaaaagtgagtggagaggaatgagagcatgtaggactgggaatgaggatgcctgggattcagttctaaaactgtcactgcataactaggaaactgggcttttgtcatgattttgcctctgtgaaagctgggatgagtccgaaagctttgagcctcagtttcttcatctgtataatgacaggctggggctaaatcagggacatcaaatatgtatcacatatactgtcacttgtgatttctatgcctatagcagacattactaatcaaaagcagttttctttctgataaagccaaaatacagtcccaggccacccataaatgagggcaatgttctgataagagttaaaacctaaaatgcttgaattctatgctcacgcaggtcctttccagcccagacaccccagatcctgaattagtggtcagcctcctgcagttttatgccaggagcttcccatatattaaactaatctttcaaaaaactccctcaattcatttcaaagaggaaagtcatggatacatttcagaaagaaggttatttatgcaagacaaaaatattattatgaaaaaactgaattgttttttctaaagcaaacttcagccaatgctgcacttgttttggatctattcaattttggtctccttttcctttctgtcttgagcagctctcacattctctttctccctggactttcatgaatttattcctaataaaaatttataattgtggcactacctacgttcttgtcactttgggggcttgttggccatataccttgtacaaataatctctatcatttattgcttcttcagagaagatgttatacatgtgcagacacataaatgcaaagtgaaaagaagcagtcagtagatgataccaagcatcaattcttctgttatattattctgaaactgaatacagaatagctgggtatctctattgaatgtttaactgtgaatttatttttttgttattgtaaaaatatttgttaagtatacacaaataaataattcttttatgatgttatcttgcaagaacatgcattttaaatgaaattgacctgtgacttatttttttttatgattttttttattatactataagttttagggtacatgtgcacattgtgccggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtagtgggatggctgggtcaaacggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtttactctgatggtagtttcttttgctgtgcagaagctctttagttaaattagatcccatttgtcaattttgtcttttgttgccattgcttttggtgttttagacatgaagtccttgcccatgcctatgtcctgaatggtaatgcctagattttcttctagggtttttatggttttaggtctaatgtttaagtctttaatccatcttgaattgatttttgtataaggtgtaaggaaaggatccagtttcagctttctacatatggctagccagttttcccagcaccatttattaaatagggactcttttccccattgcttgtttttctcaggtttgtcaaagatcagatagttgtagatatgcggcgttatttctgagggctctgttctgttccattgatctatatctctgttttggtaccagtaccatgctgttttgattactgtagccttgtagtatagtttgaagtcaggtagtgtgatgcctccagctttgttcttttggcttaggatggacttggcgatgcgggctcttttttggttccatatgaactttaaagtagttttttccaattctgtgaagaaagtcattggtagcttgatggggatggcattgaatctgtaaattaccttgggcagtatggccattttcacgatattgagtcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttggtacattgattttgtatcctgagactttgctgaagttgcttatcagcttaaggagattttgggctgagacaatggggtttctctcaccactcctattcaacatagcgttggaagttctggccggggcaattaggcaggagaaggaaataaacggtattcaattaggaaaagaggaagtcaaattgtccctgtttgcagatgacatgattgtatatctagaaaaccccattgacctgtgacttctaatgtgatcacatgattgtcaggctgaaagttttatcagttggttttcacttttaaggagtttctgtatttcacattatatttcttcagttacttaaaatgaaaaatgctggtattctcatcagaggctgaattttgagtgactattgggtagaaactttaactgaaagcatgaactttttattttataaaatgtacgtaccgccccctagaagacacaagtttgatttatagttaaggttatttcagatcaggataacctggtgtgaacatagcacccattgccttatagggagggtgggtcctctggaggaaaaatcgtctttccaaatggaaagatgaatgaatgaataaatgatcctcttaattgtaaatgagaggcagcatggtttaacacacagaatctaagactgtgctaatacaggcttgcatcacaatttcaactctgatacttactactaatgtgtgaccttgagagtctgaccttcagactccttaaactctgtaaaaatgttctagaaaagcatttctagagtctatgcataattaatctccctaaatatgtcacaaaagacagaaaacaaaagaaaataaattggctggttttattatgtattaaagagttaaacattttcttgctaaaacaatcattaataaaattaaaatatgcaaatactgtgtcacaaggtagcttcatcctataaagtacctttttacaactctaagaaaaagttctatcccttcataggaaagggcatgaagtatttcctttaacaaatatttttgcaatgtttagagaaggggtgagggatttttagccttctctcctgacattattacctacgaggataagagacagagaacatttctcttcctgtttctctacctctggctatacccctgtcaccagctctgccataagtattgaggagacaataatttgatttatgagaccatgctttatgaatggggaagatgactattagttataggtcaggaccctcagaagccctttcccccctgcattctggctcctggtaataagcagagtcatggcaggtacagggatcttccatccttctctagttcccaggtcttttcatccttcagtgaacccacataatgataatgccaggggtgcctcttgggagctgattgactaaggtgacttttagcaaaaatgaagaaagaatacagtacaagctatattcatcaacccagattctccaagggaatcttgcattttgtgtgtctggaagagaaaggtggtaattgtatgtgtgtctggatactaataaagaagaatctttccagaacctctcacttctgtcagggtcaagctccagcaagtgggtgttatccctcagataccactctcttgtcctaactcaggtaagaagaacccatctcctatgggtgaagtgaagccatgaatccatgaaaatcacagactggaacaaagtcctctaagggatgttcttttgactttctaaccctattcccatatctccagtaacatccctctaaatttggagacatatatggggttctcagaattttcttgcacttatttcctgaaatatgctgccaggtttttgagtaggaatggtttgaaaacctccaaagctctcctttaattttgccaaaatgtgatgtatttggtagaaaataaccggagcttattatgtacattctgggctacatcattgtctaggtttttataaatgtgccatgtatacaagagtatatatagagtcaccatatatacaaagagctttttaaatttaagtttgttgagaacaaacacatcagttgtctaaaaaaaaatcttctattgtgctgctgttgttgttgttgttgttgagacagtgtcttgctctgtcgcccaggctggagtgcagtggcatggtgtcaattcactgcaagctttgcctcctgggttcaagtgatactccttcctcaccctcctgagcatctgggattacacgcacccaccaacagcccaactaatctttgtatttttttagtagagacagggtttcaccatgttggccaggctggtctcaaactcctgatctcaagtgatccacccgccgtggcctcccaaagtgctgggattacaggcttgagccactgcacccagcctctactgtgcttttcctacttgaattttaaacatatcccaaaagttatgtggggaagtgaataagttatctacatagtccttgattaggtttgatcagcattagcaacatttcccaacgctgtcatggagacccaaatcacattgatatcaagctacacaccctgaagtgggaaggtggccagaaatggagactttatctaatgtcagtttgcatagactttattaatcaccattaataagaaatgtcaagggacagctgttggagaatagagaatccttcatgtaaggaaacgaatacactgaagacaatcagcattctgggcctttgccaccaaaggttcaccaggaaccttagggatttgagatcattaaaggctgtatctaggtcatgctcctctcttcccaccaggctggcataatccgcaggaacctgaacgtgcatctctagcctatgcacttaggacagtgattcctgctgtcctggcaagttgctgcagctctgaccatggagaagagggtgagaggcaatgcagaccccagccaaatggaggacttgcatttttatagtcactgcccttcatatactgaaaatgaaaatgtataatttctcatgatgaatccctagggtaaaaccaagaagtatttaattatatcaactaccagcaatgattctttcttcatgagaatttagaagtcagagattccaaagggtcttccctaacaataagattgatgccttctgccccctcctcaggcttagttttggcttccataggaccttgcattcctcgccctgtaaaaactggaagaaactctacagggccacttgatccattctctgaggctgaggacctcatcaggctccattcaataggctttttgatgacccagatttcaaatgccccatgacaggaaattctcactgttatatttgtgctttcctgttggacctagtggattttgttttcatattattatttaatttacagacaggaaaatcattggagcctggagttgtcttgataacactgttaatgcaattgccaggacttccctgtgtatgctgcccaaaccctggaacactgaattgctgtgatcgttgtaaggttccaggtgttcatttcaagggtgatcacatgacattccataatcacacttatgaaaggactaattaaaaatacagatgtcttcagctcaaaatacccagacagctgaaatacttattagttttttttatgttaaactccatatcctcacttctttccaacagaaaaactaataatagataacaaagcacagacagggagggccttcagccttttttctcccattaattgacaggctttgtttataaataaaacacctagtacttttacaaattggtattttaccataatacctttttagattactttgttttccctttcagaatggctcagccacaatattgtttgtctagggctagaggatttttataagtttgtagtccaactcttctaatatagaggtgatagtcatacaaaagatcttacgtgtccaagaacatagaaccattaacggtctttcagccttaaaaagaaggtgccttgtaatgcaaatgtcaagttgtctttattctacctgggaggtagaataaacaaaacaattattatattcaaaaacgttttagagatgtgtggacctaagaactttggcatgatgaatgaaaagctctttacagacacattgggtttgcttatgtgaaccagagcaaatgcatttcccctgactggcagataaataattaagatccaaatgtatagttaaaaataatgttaaaaacacaaaatttatgttttatcaagataatatatatttaaggtgcaaagtcaccctgcaaatgctggcatgacgttttattaatttctctcttcattcattcattccttcacatatacacaatcacaatatttgtagggcttgctaggtaagaggcactgtgtgagacactgggtataagtgtacagatatgaacaaaagttgtactggagtaagtcacacattttcaagagtcataatctgtgttcagtttggaaaatgtaccagagacagtaaatctagagatcagaaggtcaacaaaactagagtttggaaggttgagaacataacccaggctttgtatcaccctttatttcaaccctagagaagataataacacatctttgggaaagaaagctgtcaatcttctaattatctaaatcccttggaatgaaagtgaggaaaaggcaaggctggagagaagtggcatcgacctttcccctcacatggattttcctttctgacttctgcattactgtcttcagctctcatgaaaatagcatgataattattgtctgctctcccctatttcattttatttattccagaaatttttttgaggatccactaaggcaggggtccccataccttaggccatggactggtacttgtccatggcctgttaagaaccaggccacacagcaggaggtgagcaacaggcaaacaagcattacagtaatgctcagtaattactgcctactgtcagataagtggcaacattagattctctcacaggagtgtgagccctattgtgaactgtacatgcaagtgatctgggtgacacactcctcatgagagcctaatagtgatgatctgacgtagaagagtttcatcctgaaaccattcccccacccacacccctggtctatggaaaaattatcttccatgaaacaggtccctggtgccaaaacggctggggactgctgcactaaagtatacaggtattttcctaaccattagggatttatcatggatggggcagctgtggcacccagcctcatactgcttgtaaaccctgaaaaaccaaagggttctactctagggttctaatgccaatggcaacaattggctttggaagaagagaaaaaaccttctaattcctcttttaatgtattcattgacccatttgtttttcagggctatgttgtttagtttctatgtatttaaaaggtttctgaggttcctcctgttactgatttatagttttacactattgtggtcagaaaaaaaatgcttgatattattttgatcatcttaaatttgttaagatttgttttgtggcccaacatatgatctatcctggagaatgttccatgtgtggttgagaaaaatgtgtattctgcaactgttggatgaaatgttttgtaaatgtctgttaggttcatttggtctacagtgcagtttaaatctgatgtttctatgttgactttctgtttagatgatctgtccattgctgaaagtggggtgttgaagtttcctgctactgttgtattgcagtctatccctttccttagacttttaaatatttgcttcatatatttggaagctgcaatgttgggtgtatgtatatttacaattgttatgccctcttgctgaattgacccctttattattatatagtaacctcctttgtctctttttacaatttttgacttaaagtctgttttatctaatgtaggtatagctactccttctgtcttctggtttccatttgcatggaatacctttttctatcccttcacttttacttcatgtgtgtacttacacgttgaaatgagtctcttattggcagcatatagttgggttttctttttatccattcagccactctatcccttttaattgaataatttaatctatttacattcaaggtaattattgataggtatttactattgccgtttttctaattgttttctagctgttttgtatatattttcttccttttttccttagtgtcttcctttgtcattaagtgatttcctttagtagcacgttttgattctttgctctttatttttagtgtctctactataggtttttgccatgtggttgttatgaggcttacaaaagcattttatagttgtaacaggttattttaaatgtgtgacaacttaactttattaataaaaaaaagactgtacattttaactctactaccctccctgcctcattgtgaatttttgagtcacaatttacaacattttatattgcatatttcttaatcaattattgtagttattattttttaatagttttgacttttaaccttcatactagggatacaaatagtttacaaaccatgattagaatatgagagtattatagatttgattatatatttacttttacttcaaatgttttgtgttattcattagcattcagtttttcagtttgaagaaatccctttagagtttcttgtaaaacaggaatagtggtgatgaacattcacagcttttgttcttctaaaggatagttttattgggtatagcattcttagtcagcagttattttttcctttagcattttgaatatattttccccctcccttgtggcctttaagatttctgctgagaagtctgctgctaggtatattgaaactcttttatatgtaatttgtgtcatttttcttgctgctttcaggattctttctttgtgtttgacttctgacagtttgataacaatatgtcttgggttatagtcttacttgaattgaatctaattgctgactttaactttcctgtacctagatatgtatatctttcactaagtttggaaatttttctattccttcatctttctattttctcttgaactccattgacctgagcatttgctattttgatgtcaccccttaaatcctataagcttactttggtcttttcaatttatttctcctctaactgtacattttcagatagcttgtcttcaagctcactgattctttccactgcttgataattctgctgttggtgctttctattacatttttcattttattcattctgttttttacatccaggattcctgctttatttaaaaaaaaatctcaatctctatgttaaatttctctgatgaatttctaaatttttctcttattttcttgaagttctctaagcttccttcaaatagcatttttaaattttttgtcagagaggtcatcatcttcatttctttagggtcagtcactaacatcttattttatccattaggcagtgtcatttttctctacttgttcttaatccttatggttatatatcagtgtctatgcattgaatatgcaggtatttatttcagtcttttcagtttgattttttatgtgactgttctgcagtaggcctatctagaaattcggagaaaactgtctcttttggtcttttctaaaccaatgactgctgcacttgttgcagtgctagaagcacttggtttgctgtggctggcaccaaggtttgctgtggctggcaccaaggtttgtgttttggttgctgtgagctccacccctcttctttgtttctaattgacccctaatagactaagcctgctaacactcacaatggttctcataaaatgagaccaaagcaagcctcctataaagggttccagaatggagaggatgccaaaattccacctctaatacaccttttccattgtaaaaaccataaattcagaggaagtttcttcatgtcgtactgtacaggcttgggagagggacatagcggtcaaaaaggacagttacttttactgtctaattatggtttttctctgctctgtgctcaaagtcaatattacagctttgctcctgagttcttaaatattcagggtggtaatcttgcctctggatagatgctagttgggtttccatggaaggagaaatgtcagaaaactcctacttcaccattttactgatattacttcatcaggaccttctaattttgattttacttttcaatctttattttttctaaaactttttgtttcctcatttttcaagtattaaattatcctagttgttctagtagaaagcactgtcttatgtgtgaacagtgacagataaattagatattctcagaatattcaatgatggcaactagaaataatcctggctcaatatcagtttacaaatttgattgttttctctatgttctgaatttttttttttttttttgagatagagtctcactctatcacccaggctggagtgcagtggcgtaatcttggcttgctacaacctctgcctcttgggttcaaacgattctcctgcctcagcctcccgagtagttgggactacaggtgtgcgccaccatgcctggctaatttttgtgtttttagtagaaatggggtttcaccatatcagccaggatggtgtcgatctcctgacctcatgatccactgcctcagcctcccaaagtgctgggattacaggcgtgagccactgcacccagcccattctgaaatttttgtgttctactttctaagtcagtagacattcattattcactatgataactactattacatgtggctattgagcacttgaaatgtggccagtccaaactgaaaggtactgcaagtataaaatgtgtaccagatttcaagaattttatattaaaaagaatgcaaaggccagtcgcagtggctcacgcctgtaatcccagcactttgggaggccgaggagggtggatcatgaggtcaggagttcgagaccagcctggccaatatggtgaaccccgtctctactaaaaatacaaaaagtagcctggcgtggtggtgtacacctgtaatcccagctactcaggaggctgaggcaggagaatcgcttgaatctaagaggcagaggttgccgtgagccaagatcgcaccactgcactccagcctgggtgatagagcgagattgcatctcaaaaaaaaaaaagcaaaatattatgttaatacctttatattgattatatgttaaaataataatatgttggatatattgtgttatgtaaaatacattattaaaattaatttcacctgtttctttttccttttcaaaatgtagttaccaggacatcttaaattgcaaagaggctctcattacatttccataggccagcactgcacttctcccttgccactcttcattaacacatgaggtatcattctcaactatatttgctaataatttactctcctcccttctcctggcaatatttaaaatattactgagtgttttccaggtcctgtctattgtgattgtgctggacatgtaataatgaagaaagccaaataagtcccctgctttcacatgacttctgttttataggcaaccccaatgacattagggtggtcacccctgcccacgcacttagtttcagtcattactggactaaagcaattgagaagaagtacaacccattctaatatgagttgcactattaatagttcacagttgatcatatgtcttgttacttgttatctaagtgtctacagcatctccagtacaatgcttctcagagtttgtagaatatgtgtggctttggaaattcagaggtgttctgaaaacaaagaaacagaaagcacgtctgtgatcaaagacatttggggaattctgggttaaatgaaacacaacatgcctctttactgcaggactcgtcaaagcttttgcttttccaatgcagtattatgaaactctaaaagcaggatatcatgaaagtttttaaacgcatttgaccaagaattctgattctggtgagatgtttttcctgggaataaaattgtggacaataaaattttggagatggtgttcagttcatttcttcatcatccctcattttgacatatgctgtcctaggctggttctacagcagctacctctcaagtgttcatatccacactggtcttgtttgtgctttgtgtttctgggactagagctctaaaaccatatttctactctactacctggctccacctaggttctgctagttgaggaagactagaagaaggctttctgcttcctgtttctttctgcctcttgttcttttaacgatgtcctaagcaacggctaacagtactcaccctaacagtagtagttctttcctgtctcagcagctgaatccagctgggttttttaaaatgacacttacagaactagtgccataacccccgtcccccaatcagcatgggccagtttagacccctcctcagttgtttgagcctcagctccaaggtgtcccttctgtaagggtctaagtattcataattaaaatctctttcgtttgttcacacagctgtggggtggtagctatttactacaggtgctacttttggataccacagggtgttatctttgtcatttcagttcctcaacacagctctttatattaaattttctgttaaaagaatacatgcagttctttctgactcctgattatacctgtccaatatactccattcattctccccactccctaggccaacaatctgagtggtaaagcagaaagtgatttgaatgagatcatataaaggattccagcattatctcagtcactgtttctgggctaaactgagctgtctctgttctcagctctcagagtgagctcttctcagtcgctaggaagttaaggcctaagaagacgagcctccatggaacagacctaccaccagcctacccctgctggcttttcctggtttgtttagtcatgaatacattgatctgaatttgtcacatttattcttctcacttggaatcttgtatctactaccttgacaaaatcatggaaagagaccatgaccacatttttattatctgattgtcttcctggaaataaagagttgcgactgtcactggctggcaactataattgttaaacctaactgaagaattgaagtctactacattcaggagtgtttggatcctagaccctgattttggctttcaattcatgtctttctgcactggcacatttttgcatatgtatacatgttcatgtgttgtaggtccttctgtgtccatatatgcacacttgcatgtacaggaacaggtgccactgtgtaggcatgtgtgtgatgtgtgcatgtgtgaatatgtgtgtgtgtgaatgtgcttaggatagacaagaccattttcatacacaagactattttcaccactatatctctagtatctcacatagggtctgtgctaatggatactcaaacatagttattgaatgaatgaatggatgcatgaaagaatgagtgttaatgctaacacaaaaaggaatgaaatctgttcatttctttatttaaggtgggcccatctagatcagctctatttaatagacatataatgcaagtcacataagtaattttaaattttctagtaaccacattgaggaaaataaaaagaaatagaataaattaattttaaaaatatttttatataatcaatatgtccaaagcgtcattatttcagaataatgaatataaaataaataccaatgagatatttgcatttttaaaagcctttgaaattcagtatatattttactctcatagcacatctaagttaggagtagccacatttcatggactcaatagtcccatgtggctcaaaattgcagttttagtcagtttaagtcttgttaatatcctttggacaatggaggaatggaggatattttctattttctattcttcaaagtttagaataaggagtctttggaatccaggatactttctggattggagaaacgttggttgagaatgtgaatctctgataacccttaattgctgcaaaagttacatggttcagctcacatgtctttctctgtcctcccactccagtgttctggaggggaaccaaactagggccctattctgaaacctgttttcctttcctaaaatctgagcccctttgctggaaatgtgtctctctctctggaacctgatcccattccggaaacctgtatctttttctggaactggctacaactatctctttcctcttcaagctcagccatgaagaaattttttaaaaataaagaatacaaacacacactaataacaagaaagcatgtgttatcttctctctcgtatcctgcatcttcaatgtctttgtattagatcagatattgctcaaaatacaggagcctgaaatttctacccaccctttttttttgagccagaaattccctagattcacaatgtcatcatccacccctatcaataccccattttatggctgtgacggtggtagaaattcacatggccttagtggaaagccctgtgtctccccttccccctgcctcatcttctctgttattaggtacaacagaatctcagagatggctccattggcttcagaccttctgcccattacattacatacaatgtctttttaaattttctaaaatggagtaatttttaacaagcgggtggtggggagtacttcccatatttttcattaacgtatactgttaactatgccagtaaattatggataatttaatttaatttaggcttaatggcaacatttttcctcactaatgaaatggttatttgttattaggaaaatatttattgaagtggaattgtgtgatctctcacatcattattaaaccttgttaaaccattttttaatttcaatttgggtttaattaagagtcattaagcattttattgaatctaaattaaattctaatggaaatgggatttgccaaagagacagttgtgccctttcttcactctcagttctctcaaagtgacatagttacaaaaggacttggggtgaagtggaactccaatattattgataaaatggaaagaacaaaggctttgtttcagattgatcatagttctaataccagaactgcttctgacataccatgagaccttgggcaagtcatatcatttttgtgataatcaccttactcttctgtaagatgaggactgtaatagagtgtctgtggaaacaaaaggacaaaaattatataccaaatggatattttaagcttctttttttgtctgaggtatctacaattccttaggaaatggaatttaaaaaaaaaaagtttgttgaaggaaaaaaaaaaaaggaaaccgatgtgactaaaaaaatgccaatgtacatcgagttgtctatctgaagcctgaattcccaaagaggatgtaactggagcaaagacaagggagtaaattagagtttaatgagcctgaacttggaaaaggctagaccaagaagacaggagcacaggtcaactgtgatgagtcttgtccacctgaaaacacatgggaggcttcccccctgggtttggaccttatgaaacatttggttaacgtgaagcctgcatgacatggatagatctttcttggcccaatatagtggaattcaaaagtaaatcctagtcctatgtagattccttgaaagggataaatatcaatattcattctttcaacagattacctccatggatctcctatatgccaagtcatattagggatatggcagccaacaagctcagacaaatcctcttgggaactttgtgacataatggtagagaaacacatggcaacaacacaccacaaaataacaagtggtataatgagaatatgaataatgtgctctgttaagaggattgtctgatgtgccaattattgaatattgactctgcatgacttaccagcatgtcatccctctaagagtctcttctctgaattctactttggatattcaccaaagtcttaactcaactcttgaattcaatctcacctgtagctcctggaaaaaaaatgtcattttttcctgaatgacccaccagttggataagtctctaattttacctgctcaggagagctgctggagtatacctcttcaaaaagaaacattcatccttgacatgactttcacttcttctggaattagttctttagaaatatgtacaggtctttatttttgatgtatctcaaccttagatggaatcttttgccatcttgatatctgaagacagttttcaacacatacctaaacccagggaggctttttacctcccagtacttttctttgctttttatatattcaataattaaaaccagaggaaaacttatacaggccaaagagagcaagggggcagcccctgaatggttcctgcattaacactaaatatatttattttcatcagcctaacacatactcatgtgcacatgtgcatatgtatgtgagtacagaggtatgtgcacatgcatgcagactcagttgcataacttccatctacacttccagatcaattctacatccacttttactctgttctgcgatccagaagtctgacaagtgtggccaacctcaatgagtcctctcaacttttggcttctggttggggtcagcagaaaaattcagagagaaagaagagtgaagggaattaatgtgttctgtcatctcccttcctatgaggtatcatgcgtggcttcatgtgttgaccaagattacagcttctgccatatgactgtttttctccaggggactgctctctgtcctcatcccttcaggtctagggcagtcacagagttctggtattgctatccccagaacactacactgtggtgtgcccttatggttactctgcaacctgcttatgcctttgtaaatagttgctttactaaacacttttgaagttgccaagtttgattgtgctatctgctttctaccatgaccctgatttatagatgtacacagaagcactcagatcaaaggtctcattcaatgttgaactagactgccttttcagggggctggtaacattgcctattggccagtcaaggtgtctctaactgtgtttctagtcaatctgagatataataaaagtgctggaaagatcagcagacttgatccattccttcaccatgtctttctgctcccaggagaaggtcaagctctgtaagtttccatctaatggcttcttttgtcttcattccagcaaaggagaggactgagtggcccagatggaaagcagaaatgcagacagaggcctgtggaagaagaatcttaaaataactaagcaactccaagaaaacaagtgaggatttattggaaacaactgccttgaaagaagaaaaaaacactccaacttggtaagaaagatgagaggacataaaaacaagtcagattagaatcaccataagaaaattaaaaagaaagaaagaaaaaaagaaaggggatagtccaaaaaaaaaaaaaaaaaaaaagtccagagagcaaaagtccaggatacctgggcctctgtcttccttttaccagctacggggtgatctaaacttatatatctgagcactcactggcactgaaaaaaaaaatcacagaagtagagtgaggagtaaggaagacgacctagaacatcttttcactggtgtgaattgacagaaaaatcaggccattacttcaaggagtgggatgatgactttatggggatatcacctaagtacagcctgacgccccatgctaccctcactcccaagaccagccaagaaagatggatcaggaagccaggtcaacagttccatctttgatacttactagctataagactgaagaagttgtccgatatctttgtctcagttttttttatatgaaaaatgacagacaattcatgaggttgttgtgaagactaaaagaaagattaaaagtattgcattgttatctcgtataaaattaagacttaaaaaaataatttccctctctccatctctttctttcttttcttcccctttacttccttcatttttccctgccatccttctcctctcaatctgatgttaaagctctatacagatattcgttattttgctattgttgttgttgttgttgatactattattatttttgataccactattattttgttgtgcagttttgttttgttttgttttttgagatggggttttcctctgtcactcaggctggagtgcagtggcacaatctcggctcactgtagcctccgcctccagggttccagggcttctctttcctcagtctcctgggtagctgggattacaggcacacgctagcacatgccaccatacctggctaatttttgtatttttagtagagatggggtttcacaatgttggccaggctgttctcgatctcctgacctcaggtggcctgcctacctcggcctcccaaagtgctgggattacagacgggagtcactgcacctggcctgttgtgcagttttatttaccctgggttttttttttgtttttttttttaacagatattagcctctcttcagccttttccaccccatctggaatcttacaacgaactgttgggttttaacacagtgttttgtcctatttttaaaccaaattcattagaaaccaagaaaaagaagagaaaaaatcaacagtagtatttcccaaagttaaggcttaattttattttgtgtttgttagttatgggtgttcttgctagtcaatttttccaagttagagctcaggtggaattttattgccaatctgcctattgataacaaagaccatctttttgagcactcaatattgaggtggcatttccccttctagcttacagaatcaggcaatggatgaagcagttctggaaaggcttccttccgccaacttggacacattttttctttttccagcccagatgaacttcctcatttctccgctctgatgataagccctgtttaggctcgtgctttcatctgcctgggtggcatcagaattcgggggacatgtgacctcagctcttgtgtttggatggcatgtggctatgagactctgctaaagtaaacaagttttatataatagacaatgatgacaataaagatagtaatataaaaacaagttgtacagggcatctactctgctgtgctagagactctggagagatgatgtctatttctcagaaccatggtggttagggaccgttatcccatttcttaaagaaagaggcccagggggctgcaaatctttacccaaagtcatgcacccacagctagtgagaggcaaagccaagattttctttacattttgtgatctttttctctctcagtgaaaatatttgcggcggtatttttctccttaccacatattaagcaccattaaaattaagcacattaagcaagtttgcacaagaagagagagaagaggaaaatgcaaaggtaaccaggggagtagaatgttctctggccttgctgggactgtccactccagtagaaacgaaagggagtcctacaggagatgatgcagctcaggtgccttctaaggtacattcctgccacccaccttgcaaggcagaggcttaaactctcgtctttttgctccattcatatccacaatgcctcttaagatcctctggagcctttcttacagacaatattttgtcctttccagaccttgcttggtgaaaatcacgttagaagtggtaagtagaaagatgaagacttccagctccttctgttactcttcccaccacttctgttctgaaaagctagacttgctcaggttttagctgtcatcactgctcatctcatttcaaattttaatggtagtgacaagtactttcttttcttccccctctacttgtgctttcctgtttctcagtatccattcaaatccctgccaagactagaaagattcacagcctttatctcactgtctagcagagtttgaacatatctcactgcagatatggggtgaaaggtatgttattattgagactgtgatgcaatgcatcccccaaaattgtttgtcattcatttaacaaatattcactgagtcataaagtgattaaaaattcaggctctagaatcagattggctgaatatgcagtacagccctgacattgtttaaactatgtaaatcttgagtaagttactaaagcttcctaagccttatttacctcttctgtaaaatggggataataacgggtaggtgttactaggattaaatgcgtgtcaagcacttggcatgtttgcccagcatagattttgtgaagtcagagataccttgatctcggcaagaactgtgtctatatgtatctgaaggaagaggggagaaactggagtttctatgtggctccagctctgcatggctcctcctacctactgatgtggccttgaccaggccctattctctctgagcctcagtcttctcttgtcatgggataagactttcataactacacgaaatattcaaaactaatcttaaatcagtgtaactgttcaataaaatgatatcttgcactctatattcctgttttattaacctatcagtgaggcagatctaggggcctttatctgggttttaaagaagctactaggaattttcttggctacagtcagggacattgttcaaagactgtgtatgtgcaggggcagtgggtgcagagtcattaggcactcattggcttttctgagaaaaatgagctcaggaaaaccaaaatcttggccacttttccattctaacacctcatctttctctaaggttaagctaacctggtgagcagttcctagcctggaataggcccctctgccacagtcagctttagggaaatgagaaaaacagtcaaaataatgcagcccacgtgacactcatgccagcttcacccagggaaggagtggaacttaagctctccagcccctccaggtatcagcccgaaagttaacattaaatacaggactgtgagtctgaatgagtccactgtggaaggttctctaaaggtcgaagagatctatttgattcatttaaataaattaaaaaactttttggaataactttagatttgtataaaggtctcaaagctagtccagaattcctggtatatttcttctagcttttcctgatgtgaacatattatatattatggtatatttgccagaactataaaatcaacactggtaaattactaactaacctccagactttatttgggtttcaccaatttttccatgattgttcttttttgttcaaggatttaatctagtatacttcactgaacatagtctatgcatgacttttaatgtgctgattggttttgtgctgctatagagacatatttctgggtgatctacaaagaaaagaggtttatttggttcacaggtctgcagactgtaagaagcccaacacctccatctgcttcctgtgagggccttaggaaggttccaatcatggcagaagggaatggggagccaacatgtcacaatgtgagagagagagagagcaagaaagagaaagaagaggaaggtgtcatgctctttttagcaatcagatctttcaggaactaatggaataaaaactcactcattaccatgagaacttcgtcaagccattcatgaagaatccacccctatgacccaaacacctcctgctcggccccacttctaacataggacatcaagtttcctcatgagatttggagggggcaaatatctgaactacatcaaatatgtcagtatttgctttccgatgtagacagttctgtgtgtactaaaagagtctacaatttgagctctgatttaagcatctttccttctagagaaatccattccttgtatgtttatcttagtcatatcccaaggaagtggtcaggatgctcagattttacttaatacccttatgagaaattattttgactttttactcctccactaggtggttaaacagtgaatttccttgtttgaagaatgcattgattatgtgccaggcagtgtgctagatgcttatacagattacctaatttaattatcctaatgttcctttgtgggaagtagtagtattattactgttatccagacaaaaagactgggttccagagagatttatcacttgcccaaataaagtggaagaaccagaatttaaagcagtcttgtaactttgaagacaatttgctcctctgatgtttccattttaaggcctctgttttgcagagctctagctctagagcaagaaaaaacctacggtttctcttacaggctgcaaagagatggtgttcacctctgtgtgcttcaagatatggtttacatagctaatgtacagtgctcttagtcagcattagttcaagattaaatgtttcagagcctaaagagtaagatgtcagtgattcctgatggatctaaaatagcaagtaaatcgtgcagtggttcaaatgctggataaaagagcttatctgcagctgggcacggtggctcacgcctgcaatcctaacactttgagaaactgaaatgggtgaattgtttgagcccaggagtttgagaccagcctgggcaacatggcaaaaccccatctctacaaaaaaaaaaaaaatacaaaaaaattatctgggcttggtggctcatgactgtagtcccagctacttgggaggctgagatggcaggatcgcctgagctcagggatgtcgaggctgcagtgagctgagatcatgccactgaacttcagcatgggtgacacagcgagatcctctctcaaaaggaaaaaaaaaaaagcttatctgcattatctcccagctctcctcacaacgtatatacttaacagaagcttggcattttactcctgaatgcccaggatactatgcatacatttccctccctgctggtaggtgtttctctgggaagaggaaaaccacagcactttgccgaggaagattagaatcagcgtggggaaaattctgaattgggcgcagagggctccgactgagtgtgggatagggggattcaaggacaaggacggaccaggaaggtcatgcattcaggcctgagacccgtttcatcaaccttgggtacagggtgtgtgcgcatataactacacataaatccagattaaggagagacagacaaattttccaacacttgtaggcacaaatcagttcatttatttattcatctatagaacaagcatttattgagtacttttgatgagctaggctctgtgtccacagatttctcatcttagtctgcttctcaaagctttattaggccttccatgggtgcagctatatgccagcctcaggaaacctatctttctgaaaaatacatttttttttctttcaaaggaaaggagaagctagtttctgagggacacaagaaaatcaaagaaaccagagcaaagtgcaggatgccatattcctaatagcaggaagaaaacagggtcctgttgtaccttagtgaccccgaattcctcagggtggagcaaatgcagaagggctccagggccatctgcatctgtgattttcattattgcatcctctctgtctcttccgtcctgtatataccagtaattaaactgacaatgagaaatgcacatctaggtgtcaggatagagtgagtggggccatggtggacattgtgggaagggacagaatggatgtgctctgccatgagtggaccaccatcactaaaatggacagttgttgtaccaaaaaagaaccatagacagagaccatagacagaaaggacacatactcctttgggaaatatgtactgcagcaaagaagggtcacttattgctataaattttcctctacgtactgctttagtagtatctcacaaatgcaaattttaatgtattgttttccttttcatttagttcaaagtactttattttgatttcacctttgacccagaacttatctagaggtatgttatttgtgttcagatatttctgtttttcattttaatttgattttaccatggtcaaagaacatattttttacaactttaaaattttagcccgggcaccgtggctcacgcctgtaatcccaacactttgggaggctgaagtgggtggatcatgaggtcaggtgttcaagaccagccagatcaacatgatgaaaccctgtctgtactaaaaatataaaaattagccgggcgtggtggcgtgtacctgtaatcctagctactcaggattgtgtgaggcaggaggctgaggcaggagaattgcttgaacctgggaggcggaggttgcagtgagctgagatcgtgccattgtactccagcctgggcaacagagggagacttcatctcaaaaaaaaaaaaattgaaaatgtgttaatttaataatttgaagacttgtttcatgggccagaatatggtttatcttggtaaatattctgtgttcacttgaaaagcatttgtattgtattgttaggtggaatgttctctaaacatcaatttagtcaagtagtttattgtgtattattcacttttctttgcatttactgattttctgtcaacctctttatcagttattgagaaagaggtattgaaatctctaggtttccacctgtaattgctgatttgtctatttcttcttgttatttagtcagttcttttttattttttttctttttttccagagataaagtctcactctatcacccaggctggagtgcagtgatgcaacctggcctcactgcaacatcagcctccctggttcaagtgattctcttgcctcagcctctggagtagctgggattacagacttaatccaccatgcccagctaattttgtaattttagtagagacagggtttcaccatgttggccaggctggtttcgaactcctgacctcaagtgatccacccacctcagcctcccaaagttctgggattacaggtgtgagccactgcatccagcctatttagtcagtttctgatttttgtgtttgaagctttgtttttgggcatgtgatatgatttggctgtgtccccacccaaatctcaacttcaattgtatctcccagaattcccacctgttgtgggagggacccaggaggaggtaattgaatcatgggggctggtctttcccatggtattctcatgatagtgaataattctcacgagatctaatgggtttatcaggagtttctgcttttgcttcttcctcattttctcttgctattaccatgtaagaagtgcctttcacctcctacatgattctgaggcctccacagccatgtggaaccataagtccaattaaacctctttttcttcccagtctcaggtacgtctttgccagctgcgtaaaaacagactaatatagcatgtaaatgtttgggattgttatgtctcttatgaatttacatctttatcattataaaacaatttttttctatccttggtaaaatttcttgctctgaaatttagtctgatattaatataatcattacagaattttttaaaaatggactttattgttttagaacactttttatacttacagaaaatttgagaagataatacagaaagctcatatacttcaagctatgggatgaattgtgttcaacaaagaaggtatgttgaagttttaacctcctcaaaatatgacttcatttgaaaacagtgtaattgtaaacaactattctaagtttattttcaaatgacactaaaccacttcaaggataatgcaggtatcttaaacagagtattgtcagttcttccctccagttccttataaaatggttgtcattcatttcatttgtctatatgctataattattcaatacatattactatttttcttcttaacaaattgttaactactggatcaattaagaatataaaaaatgaaagatttaattttgtcttcattccttcttcctggatgcttttcttttctaaggtaaatccaaaattctgacctatcatttttcttctctttcaagaactgcttttaatatttcttgcacagaaggtctgtgactaaatttcctgtttttgtatgtttaagaaagtctttatttcttcttcattttttattttaaatcaggtaaaatttatataacataaaattaaccattttaaaatgaactgttcaatggcatttagtacactcacaatgttgtacaactatcacctctattcagttcaaaaatttcaccctaaaagaaaatgctgtgcttattcagctgttgcatctcatttctctatctttctaagccctaaaaactaccaattggggtctgtctctatggatttactacatcacatattttatataaatggaattatacaatatataatcttttttgcctgtgcttcctttggtagacataatattgttaaggcacacccatattgtagcatgtatcagtgcttcatttcttttcctggttaaataatattttattgtatgtacatattataatttgcccatttattcatttatgggcgtttgggttactcccaccttttgactattgcaaatagtgctgatcttaatatgtgtgtacagtgtacatgtgtttgtttgagtatgtttttaatttttttgatatatacctatgagtggaacttttgaataatgtggaaaacctatgtttaacttgttgaagaacttcaccctaacatttgaaaataaatttcacttgatatagaattcttggttgttctcttactttttatttggcacttttaatatttcattgtattttcttcttgcttgcatagtttctgataagaaatctgctgtaattttcatccttattccttgaggtaacatgtttcttttcctctggaagtgctcaagattttctccttgtgtttggttttctgcagtttgaatttgatatatttgagtgtagatttttggcattgttcttgcttggtactctgtgctttctatatctgaggttttgtacctgtcaataatttggggaatttcttagccattattcaaatagttattctgtttcattatcccttttattctggcacaccaataacacatatgtcacaccttttggaatgccccactgttcttggctattttgtacttttatttatttttcattcttttttcgtttcattttgagaagtttctattgacatgaatttaagctcttctgattttttttacttgattttgtctaatctactgatgagtctattcttcacttctgttatagtgcttttgtttcctgtttgatctttcttagaatttccaactctgtacttgctcacattacccatctgttcttacatgttgtctactttttcccttaaagcatttaacatattaattatttaaaattatctgcctgataattacaaaatctatgttatatttgattctgattctgatgcttgtctcttcaattttttttttgccttttagcatgccatgtatacttttgttgaaaattaaacatgacttattgagtaataggaactaaggtaaaagggcttttgtgtacattgctatggaaactgagctaggcattggctctgtttaatgttttctttatctatgcgtattaaagatttcaatttcctctggtgtccttgatttttttttccttttttgtgtttgagttttcctaaaaactcctttttaatagtctgtgccttgcagttcttttaactgtaattcactgttattatatgaaagctttgatgacagggtggtaaggtatacactttctataatgctatgattaagcctcagtcttttagtgggcttctgtctctgatctgtgaccatcctaagtgtatctcagtgttttttcccatattaggtaagacatgaagggtagagggtggagaatggagacatttcccttactgcacagtggatatggctttagtaaagtcttttctcttgccaagtagacttgtcttatggagaatgctctgggcatatttcaaagtggttactttatccttccttctgccataaatgtaaggcttttctcttgcctctttactgtgagaaatgggtaggttttctgttgttttcaggaggtaaaaacccaaggaacagtagaggcttccctaagagtgtggtttctaggaattcttcactctccagctacttcacactaagactccagcaatttattaaaattatgatttaagcattactatcagctaatggctccagctacttctgctccaagtaagctagtcatggctgcagaaccatgcagtttcttatctttctagatttcttggtggtactttgccctgtgacctcaattctctgatggactcagaaaaagtcatgatttttggtttgttcaggttttttttttcttattgtacgaatagaagtgataaccttcaagacctttacatgtcagagctaaaagccagtatttatttcactggtgttagtataatatatcctttcccatcatttaacttttagtctatttgcatctttatattccaatatttttataggtaacatttagttaggttttgttattttatccaatctgacaatctcagccttttaatttgagagtttaggtcatttacatttaatatatttattaatatggttcagtttaaatctattctctttctctttggtttctgtctgactaatttcttctcctgtttttttcttctaccctctgtttaattaattgagtactttctgcgattccattttatattctttagctcttgtctattattacattttactggttgctttaaagtttatagtttacaatatatattcttaacttactacagtttaccttcaagtgatattatatactttgtatgcattataagaaccttaaaatagtatacttctatttctatttcatttctctgggcttttttatttttattttattttattctattttattttacttttgagacagagtttcactctgtctccagggctgaagtacagtggcatgatctcagctcactgcaacctctgcctcccaggttcaagcaattctcctgcctcagcctcccaagtagctgagattacaggtacccaccactacacccagctatttttttgtatttttagtagagacggggtttcaccatgttggtaaggctggtcttgaactcctgaccttgtgattcacccgcctcggcctaccaaagtgctgggaatacaggagtgggccactgattcttttctgggcttttttgttactgtggtaataccttttagttttatatatgttataaagtatgcatcacatatttattattttgtttaaacagccaattgcatcttgaaggatttaaacaataagaacaaaatcttacatatttgtccacagacttaatatttcttgtgctatttatttgtttaaaacatgtgtattaggcagaagaatagtcttttacctccatgatgtcaatgtcataatttgcagaccctttgaatattttaacatatataatgaaagagattttgcagatgtgatcaaagttaaggaccttgtaataggagcttatcctggattattcagaaggccctcacttaatcacttaattctctaaaaggaaagaacctttcctggctgaagtcagaggctgaggtcagaggaagacgtgactatagaagaatgatcataggattgcaatattgctggtcttgaagacagaggaaggatgtgggttacatctagaaactggaaaaggtaaggaaacagattccccttcagtaccttcaaaaagaaacacaactttgccaatatcttgatttttagcctagtgctctctgtgtcagtcttatgatctatagaactatacgataataaatttgtttttttaagccaccaagtttgtggtaacttgttagagtagcaatagaaaactaatacatgatgtatcatcagtgagaataccatcacccccaagaggatgaaattggttcttggatgccaacatacttttttatgtataaatattactttttgtgtgtaaatcatgaatatgcatgcagtacataaatagatatacagtgtatctgtggcattaaaactttatgacttagtacttagggaaaaaagtctaaaaagactccttaggggatgataataagaaacacttgagaaacactggttcagatgcatattttcatcgtcttattttccttcagcctgaagtatttcctttattgtgtcttgtggtgtaactttaccatctgtaggtggtaaattatttcagtgtttctatgtctgaaaaaaactttagtttgctttcatatttgaaaaatactcttgctgggtatagaattctacattgacagttttttaccccttttattactttaaaagattgttgcactgtcttttgtttttctggtttctgacataaagttcactgttatccctaaacttgctcttctgtgtttaacatgtcctttttctttgtctattttgaaagtttgtactcatcacttgttttgagaaatttggttatgctctgctttgggttagttttctatgtttggtgtttatagggcttttcaaatctacatatttatagttttaatctaacttggaaacatttgggcaactgtttcctcaatttttgttttcttctcctcttttgggtattccaatttagtgtatattagatctcttaaaatcgtcctatagatcactaatgcttttctccatttcttttttacttttttaaagtatttgattttgcatcatttctattaccatgtcttcaagtttactaatgtttcttccagttatatctaagctacatacatcatagatctttctctcaaacattttacattttaccaataatattttggtttatatttatatttgtcctgtctctacttaatttttaaacatatgagaaaaattatacatccaatgtccttgcttactaattttaatatctgtgctgatactgggaagttttaatttattgatttttttcttattattttagtttttgtttgcatacttggtaattcttgattgtgtaccagatattgtgaagtttgcatttttggatgtttgatgcttgcatgtgtgtgtgtgtgcatgttcttaacctttgttctgaataaggttacttgaaaactggttctctagaattttgtgttttaagatttgttaggggagaccagaacattgtttattctacgactaatctttctctagtactgaggcaagaacctatgctgagaaaaatatgagcatttctttgaattcattaagagagggtgttattattgatcagccgtgtcaatcatggagagcagatggaagaggtagcacatgtacccattatctgcattctatattatgtatattcgtgtaataaagaaccaagaatgattaccttggaattttcccaagatactgagatactccaagtaggggggcatcagggaagatgactgagattattactcacattttaaaataagtaaggtcgaagaggctaaatgactttttaaattcaatgagacttcaatgcaagaaccaggatttgaattccatttaaccccatttttaaatagccaatttaattggagagatggaagcaaaatgacagacaatgaaagtgatattggggcttcacaagactatttcactgtcccttaactacattatgtaagttgctgtgtcatctacccattctaggtgaggaccacacgtggaaaagggaggctgagaatgtaagacatcagcagagtgtggatctgatagctgtgttgggactaatggaagatagatggtttgagaggtaaggagatggctgggcactgctgggaatgttttgaaggcacatctgggctaaacagggagtatcatgaatgattagcagtatttgctttgagcttggtgaaatgaaggtaaaggagtgtaaataaaggccattatgttaacaacctaggcttcttttcacaagatcatgacaaagaccttggtggataaaatcttgctggttgtattacttttttgtttatttgcagttagttagtttgaaatttcctaggtgaaaccatttccccttattgcaaatatttttcatgggactattgatgtcattcttccactcccttgcagcaggatggacagataaccacagaacccaccaaaattcttctctggaaatgatgcatatatatatgcaggcacataaaaatatttatatagagatatatatcttttctatatataatacacatattttatagataaaaatattttatctatagaaatatacacttttctctctatatatttattaatatttaaattatatttatatgttagaatatatagagaaatatatatagaatatatatagagaaaatacatattttctattttctctatatattatttacatattatatatagaaaatatatatattatctatatatttctacatgtattctatatatttctgtatattatatataattatatattatatagaaatatatatcatatattaaaatacataatgtatattcaaatactttgtttttatatataaaatacttttatataacagtatttctataaaaataaatattttatatatttctatatatctatatttctatgtctagcatagaaatatatatattattaaaaatatgtaatatatatttttatagaaatactttgttttggtttgctgagctataaaaatatgtcgggggctaacagtgagcatctcttctagtttcatggtgaagatgatgatggtaaagggtctggactgagccacacttgaaagataacaaatatacttgagaatctcaattgagccattcctgaaactaacatgaacttccttgttatataggccaaacaattccattatgttcttaaaccagtatctcagtttggtttccccagaagcagaccttgagacaaggatttaagtgcaagttctttatcttagagataatactaggatataatagtatgaaagaagagaagcaaaacaaggaacagaagacagtcactaaaagtcttcttatccaggcagtaaccacaatacataattggagcgtaatctctttgggaaaccttaggagccagtataaaaatgtgtctgcagattatcccacctgtggagagaggggttgggggtatctatgtactatgccctttagtcagttattgagttgtgatcccaggagacatcaattcctggaagttctggctgccttgtgggtgggtggcagcatgggctcgtagaaccagaggaagccctcaggcaacgaaatgcagggctggccaatttaagttgggctagtgtggactgaggtgagggtgaagagacatgagtgtcgcaaaggcgaggtctgtcgcagcttcactgagttgaatttccatcacctgcaacagagagtgctgggagaattcagggcccctcatgtgctctcagacctgatccatgccaccatccagctttgtagagaaggcagcactgtttccctttcttgaaggatcaccctgccctctaggtggcatatgtgtgtaccccaagatctagacactgagaatggaactcggtagcctctctgcggagaaagacaaacccttatgaagatcagatgaggctttcattgcaggaggccttatactatttacccactgacaacttctttctcatgaaagtttgttttcagggttgtgccctgcctaatgtgatttgtttatttttcttgagtgagaaccagctttggcttttaggatttggcctcagttgtatttcccattagtcattttccctgcaataaatgttgttggctgtaaagttggagtccttttagcacaactgggaggggcttgaggctcccaaatattggcctttttctagaggaagcaaaaagaatagcatgaggtaaagaagagtgtctgaagtcagtaactattgttttgatatgcttagattttacccccacatcttattctttacccacccaaatctttgacactagaacatgagaaggaaaataaggcaggcaggcaggaagtgatggtggtacaaaattaggctggagtgatgggcaggaaccatctcccttagttctaagatcaacccaaggaaggtcatgtcctcaaggaaggatggatcattcccacattcaaactgtaaacaccatcatctcactttttataaaggctttcttatgagctcctgaagttgagcgttaactggtaaatgtgatcgtgtaccacattccccctcctctcttgccccagaccctgccaacactacaatcttcatcagatcacacccaatcagagaacacttagtgtagatactaagagttgggggtgcattgttcaaaatctctgatctttggtaaagttcactcattaagtctgtttttttaagcatctgatccattccagggaccgttttagacacctgcaataaagtgatgaaaaagaaagacagtctcagtcctcaagaaacttctgttctgattagataggcagaagacaaataagaaagacattaattcaatagttatgcaacatctctgtgccttagtttccaccaacatatgtgaaatggagtcaataaaaacacccactttgtgttgtaagagttagatgacctaagatggaatcgatggaagagaccctcgcttattcatcattgctccctgtgtatccattctctggtagaggctgaattctaaagattctggtcagcaaagccctaaatctgaacatgcttgaatcagatgaattctgcaagggactggcacagaatagggaacccttcttgtgctctggacacaaaccctaagccaggtgtacctggacatcattttctaggatgcacaaagggtcttcattcattaatgccttgcacatgtcagaagggaagagaggctttgggcctcagccttgccattcagacccagctccttactggtacaacccttccatatcccttacttccagggcctgggagcatggtctgcaatgcccaatcatgtctggatgtgcctccaggttcagacattactatccctgctttttctggttttcatttccttttcttgtgtgctaggcttttgaaatacatattgcagccacttgttgccctgttttctaagctgccttgaactgctgccagaggctgttgccagaggagctaatgactaagtcactctccttttggcctctggcaggactggaaatccacttggggatggggtagcaaaggcccagccatcctgaaccaatcaggaaaccacaataaaagtgccgaccagggagtcagtcactcaccctcaaagctcagcgctgagctcagcatggaggtgtccacgaggctggggatgctctagtttgcttctgcagaaccacatcagaagcagagactcaggcacaaaggcaggaccttcagagaagccttggggggtatcccagggtcagcaggaaagagaaactcactgtgtttctgagccaggaaagacagagaacagcaaagaaactccaggctgtgagccaaagacggcaaacccaggtgaagtagattatgaataacaataataaataatagttaacagctattttgaacttacttcatgtaaggccttatccaaacacttttaaagtcctacctcattcagttcttccaataaccctgtcagataggctctattatttttctcactttcagaataggaaactgagtcacagatttagtttgcagtggcccaatgttgtcccagtgattccctcttacaggacaattgcaatcctcttggttagtaatcctgatttcaaaatgcatttcccagttggtttatttgttcaggtgtatccagcacttgtactgagagctcaggatagagaagataagacagtcctggtctttgtctggctgattctgatggccacagcatctccagccacccattttgacctgttcttgttttcacctttgctttccattatttatgggggtttatagtacagtaaaccattaggttggtgcaaaagtcattgtggtttttgcctttaatttcaatgtcaaaaaccacaatgacttttgcagcaatctaatagtttctattttctgcccatctcctacaccttcatctctcttggatttgccatcacctagaatgtgcctcttccctatctaccaattttgctcttttgagttctgcctgtcctccaagtatcacctacagtttccaatgttgctgccttcattaagcttttcacaagaaccccaacctcaggtcttctctctctcctctgaactgaggggatgaacactttgcagcaagtttagagatttttacctcatacttccttgcattgtccatttcctttataactgaagagaaatggccgtatcttatcactctttcagtttcttccatatgctattatggagtagttaaaaatagcttatggattaaggaaataatttaacaaaaaggatatggtgggcagcttctaagagggcactatgatccccacctcctggtattcacgtcattatgtaaccttctccccttgagtgtgggcagaacctgtgactttcctctagccaatacaatacagcaatacttataggctgccacgtctatggttaggttatgtaaagttgtgaattccatcttgttagtagactctcactggctttgaagaagcaagcatccatgttgggaaggcctacctggcaaggaaatgagggcagactacagccaaggagaaactgaggctctcagccccacagccattaaagaactgagtttcgccatcaactccatgaggttagaagcagatccttcacagtgcagccttcagatgagacctcaaccctggctgacggtttcagttatactttgagacaccctgaaccagacagcccatgtaaactgtgccctcgttgctgacccacagaaattacaagatgataaatgcatgttgtgttagtccattatatttgtggtaatttggtacacagtgatggataatacaggaaggttcagcagacaaagcctttttggaagaattcaaatggattgaaaagtataactaaggaaagcaagagagtgaggtgacatttgaggctggggaagtgtgtgagcaatggctttatggaatgttcacaaaagagttccaggcagacctggagatgtagacaggaagctaactggggaggccttaaagcaaaaagaagaaaaaaaataccaagccagaagaaagaaaaatggtgacaatgtagagaaattgtgatagtgaggggatacctccatgaacattgagaatgagagaagacggagatgctccattcataccagatggcctttaccttcgtataaatgcaggttctcaggttatctgctgaaagcaagagaggaagagggctttttagtgtaacaatactattgatgacaataagtcaccattttacatctcacttaggcctcacagcctccttatgagaggttttatttccatctacactttgtagataaagattaaaacattcagagagattaagttacttgctaattgtcatccagttcagaagtggcagaatttggaaacaaactcagatcctagagccatggtgtcatactgaggttctggaacatttttctgcagatgctgtggggaacatgctctttgccagtgctgttttactgctctgtgtcaagagtgctttgggaacagtgacagaaaacatgatgggtttagactcagaaggaggaagtggtagaaaacatgatgggtttagattcaggaggagaaggtggtacaaaacataatgagtttcacctcaggaggaggaagtctagcaggagatagaaacaggcagaagagaggcttttttattgagaagacatgaagtaatctagtgtatcaaggtaaatttttcaggaggtggaagacaaccagtgtgtgaaggttgtagctactggagcatctgcacacaggaaaacacgagcttcccagagacttcagatcagaaagcctagctgagctgtgaaagaagacggaagatgagggactggctccaattataaagtaaatcatagagtaagatggtgaatggagatatgtaggtaagggatacaggaaacctgtccacttcattccaataaacattgatatacatgctcatagattaattgaatctttcactgtgattcccggacaaagcagtaccatctctgaaataaaagcctctattttctgtttccatctttatgagtcaagcagttgttatcatgtttttagaaaacaaatgtaggcttcaaattcgtagttactccggcctattcaatgaaaacaacaatcatatgtcaaaatgatacgatggcatgatggttcaggatggactgagttggcatgagagtttaccaaggaggatggaagcattttccaactttcagaaaaagagtgatggtgtgctcacctttttggcataatcctggggtattgagaaccagccctcatgcgatactgagaaaaccactaagaaggcagctatgacgtttctttcctatttttttctcaatgcctagctctgtgtttggtgcctaataggtgacttataaaagcatattgacagaatgaatgagtggggaataactttgtatgttgctttgctcagtccctttgcagtctattttagataaacatacattctagtgagtaccaggaattagacagcacatatgcagttcagagactgagggtctgagaagtccagactcctctcccagctctcctctccacttacagaggaaaccaacctcctcttctccccccacctcacagaagagggaggccagctctaatggccttggccccagtttgcttgtataattaatgtgggatttttcctcctctagtaaaaaatgaccttgtcaaacaagagacgacaaaatcttggttactgagcaactgtggactccctgctgggatggcatcctgggccttgcaaagagaaatctaataaaattggtgtcaggggctccctgggtgccagttcccctgctgcctgaccccacaatcccaatttattagccaaacccaagaaagcagacaaacctcactggctccagacaggagacttccaagtgggagctaatgtgggggctggggctaggcttcagcaaaaatgacaagggaaatgacaggaggtgccagccgaccagggagcctggggaagccttattcagagcatcatgctgccttgacagggccggtttcaacttggtagaagaatgtgttagaatggcccattgggaaaggaagtgttttttctctctttgtactgttatttgcagggccatggacagcatgtcttgcattagccatgttcctgggagtcagcaggcgtcagtagaggaatagccaaagaaaaatatttgcatgtggagttttcattttgtaaactgagcacttcttcaagtacaagagagttttaagtgtacagtcactatttacccttccacacaaccaaaactccctgcgataggaaacactgatttgcattgtacactagctgcactccttattaactaaatgatcttgggaaaatttcttaacttcttcacctataaaatgagataacagtactattctcataaggtgaggattcaaatatgagaaaaacagaataaacccacaaaacgatagcaagtcactataccagcaaaaatcagctagaaaaagaaagtctatttcaaatagcaatgagaactctaaaatgtctaggaattgtcttaacaaataatatataaagcctatgggggaaagtgtcaaaactctaataaaggacataaaaaaccatctgataattttaaagatattccatgcttatgaatgagatgtcttaatatttaaagttaccaattatcttcaaagtaaactatgaacttaatgcagtgacaacctaaatttcagacagatttaaaaatatctagagactagaaaaatgcacacaaatgtatatgatataaaaatataaaagcccataaataggtcaattttggaaaagaagaacaaaaaagagcaatgtactgcactaaatgttaagatatattacaaagtcatagaagtgaaaacagtatggcagtggcccccaaaatgaataaacacatcagtggaacagaaaggaacattctcagggagttatatgcatacctgagcaggtgatatatatatatatatatatatataaaagatgacaacaaaaataagtggataacattttatctgtaagttttaactgatggtgctgagaaatttgacttaccacgtggatgacaatggaaatccttttactacaaataaaagggtgtccagatggattaaagtccaaagtgtaaaacatgaaacttgaagtttaaacaaagaaaatattattaagattaggagcacagaaggatttcttaaaaaagtctcaaatatcacaaatcatatgttgtcaaagttaagaatccctgatcataaataccatagacatggttaataaacagttgacagattggcagaaattacttgcaagttatttgcaaattttaaaattagcaaaggacgaatatctataatgtataagaaacacccaaaagtcatagaaatagaatgaagggaaaatgtatgagtaggcaatacacagacaaggtagtcctagtgaccaataaataaataaaaagatactgaaactcattagtaaacagaaatatgagtggaaaaatgcaatattactttatgccatcaaattggcaaaagctaaaatagttgtataatgttgggaggaatatgggcaaacaataatcttttactttttattttttatttttttaaattttatagaatatatttatttagtggtaagcatctttaaattttatactaaaattttccttctatagaagatgatcataatattttcttttttttcttttattattatactttaagttttagggtacatgtgcacattgtgcaggttagttacttatgtatacatgtgccatgctggtgcgctgcacccactaactcgtcatctagcattaggtatatctcccaatgctatccctcccccctccccccaccccaccacagtccccagagtgtgatgttccccttcctgtgtccatgtgatctcattgttcagttcccacctatgagtgagaatatgcggtgtttggttttttgttcttgcgatagtttagtttactgagaatgatgatttccaatttcatccatgtccctacaaagacatgaactcatcattttttatggctgcatagtattccatggtgtatatgtgccacattttcttaatccagtctatcattgttggacagttgggttggttccaagtctttgctattgtgaatagtgccgcaataaacatacgtgtgcatgtgtctttatagcagcatgatttatagtcctttgggtatatacccagtaaagggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgttttttccttgtaaatttgtttgagttcattgtagagtctggatattagccctttgtcagatgagtaggttgcgaaaattttctcccattttgtaggttgcctgttcactctgatggtagtttcttttgctgtgcagaagctctttagttaaattagatcccatttgtcaattttggcttttgtttccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctcttatttttattaactgttgttaagagaacaggctgatgcaaccagaaatacttagtctaatgatgtttgggcatatcttatgatgctgcaatctcactcttgtttgtacagtatatttgagagaacatctagccccaatttcataagggaacacatagaggatattcatcaccatggtgtttgaactagggattgtcaaatatgaccaatgggccaaatatgtccacaggcatgtatttgtgcactgtctatggctgcttttatggtataacagcagcaaaatccttaaaaccaagacttcagaacccccaaagccaaatatatttactgtgtcactctttataaaaaatgtttgctgacccctggtttaaagtatcagggaacattagacaacctagatgttccattgcaggggaaaagctaagggaactataatggacacacagtatggaatattacgttactgttataagacattaactacgtgagacatatactcataaatgcagtaagatccgaatgtaaggaagaaataaacagaaccagtatacatgaatatacttttatagaattaaaaatacctacataacaacaacactatacaatttgcaaaaatatacaaaatattaaggtatcatatcaaagacattatggttgataaaatgaggagaggggacacatgaataaaatacaccatgagagagtctttgtatgagtcttacaatagaagtatgctatgaaatcagaagtgtgattcactcatgcctctatgcctgagattcaaaaaataaatgtggaaaatgctgagtacaatgctcagtacactgtgattttcaaaaagcatgcattaccatcatcatcatcattatcatcatcattatcaccttattattaatcttttgaaagtgaaaccctaaccatggagctaaaatcaagaaagaagaacatgcttaagacaatcttgttgcatcagtgagcctaggataatcgattgaccgtcaccctgtttagaaaaactctttaggggtcaaaagagttttatgactccttttatgactaaaatctgtgaattgattgatggagagggtcaattgtttcctgtcacagtcactatttgcactcgtcaatatttctgtttctttgccttccagattggctctttatcctggtcttccttttagttggccagagacttgtgactagttctgactgaggagctgttagtgtaagtgttgtgtgacccttgtggaccagggtatcagttgctctttctagaccctccagaactctctatcctgctggcactgtggctagctatgtctgcagtggtggtgtctctttagtccctagaggaccacaacgaccagagctaatgcagtccaacaatggatgtgttgattgaaatcactgagatttgggggattggttgttacccagcatagcctagcctatacactgactgacacaccttccaaattttcaaagacctggaagcttaaaattggaaagaccctcaaatgccatgcaatcaaaaccccaacatgggcagagggagtgaatgtttagaaagagaggctcagccctagtgataaagagcccacatcctcctcaaaagctcctgtcctttttcactcacctcttatcattattgagattcttctgtttggagccaaatttcacctcctggccactttgactcatttatattagttctgcctttatccctgtttcacacaataattcttcagctaggggagtatggtagtcagaagaatggtcccctaaaagatgtccatatcttaattcttggagcctatggatttgttacctcaaatggcaaaagggactttgcagatgtgattacattacgggtcttgagatagatagaagattatcctgcattgattgagaaggctcagtgtaatcacaagggttcctataagagggatgcaggagggttcgagtgagagtaggagctgaggcagtggaaacagaggtcagagagatgcccctgctggaagaaactttgagccaaggaacccaggctttctctagaagctgaaaagaataggaacagattctctgtaccccctctctaccagcactgattttagccctggaagacccacttcatacttctccacaaactgtaggatataaatttgtgttgttttaagccactaagcttgtggtaatttgttacaagaggaaaagaaaattaatacagtgagattaccatgtttctttgaattttcagtttccagaagagttgccttttgctacacctggtttctttttcagtctggtcctctgatattttaaaaactggtttcatcaatccagtttgtaaaaatatgggatttctagaactttgtttttattctggttgtgacttacttaagaaaggaaattgtagcaaaattagcactgcctagaacagtcaccaaagcaacacagactctctaagcagttcattgaacttggtacctacccagactctaaataaatatttttcgtagttgatattgctgccatttagacagatctccccaattccatagtccatagttgttcagttgatttagggggaattaagtgtggattttattgattccttcagattaccaagtaagagttagttaattcatgagtcatgtatttggtcaaaactaacagcattaatagtctgtgttggaactattaatgagaattcaagagtctgacaaaactttgtcagatttgagaaacagaagaacctgcctttttagggcaaaaccatattaatagcatttttaaaatagatttgtatgttctagggtccttatcgaataaagcacctattgccttatccaaatctcaaaacaatcatatgaagaagggagtattattattattgccgtttttaaaacaacaaaatgtcattaagggttgcttaagcaattcacccagttttcacagctagcaaatgagggagctgggctgaaaccaggcagtctgactgtgcagctggtgccttaaaaccatgctacagaatcactcataacgttatagctgtatggtccttactggcctgtggcttagatgtgtcttattccaggtccagaggctgcctggagtatgtggacactgtccttggaaatgaaatgacttgtcagctcatttttgatggatcacatttcttagaataagcacaaaatattttccatttgctaagtgattttatcatgcctctctgggctggactttggaggggagagaggaaacaggtttcatggttaaagcctgagacatacctttcaggcagtcatgggtgaggggttagtaatgggtgacttcggcccctcttcatgctcacctggcacaggaaactctgggtggtttggctccagctcttgaaaacaagttccttgtttgccctcctgagttgatggtctggtggagaatttgtctgaaggaatttgttccaggaaaggtccagctgcatttgacaggaaagggagaaaagagagaacgaggcataaatctctggccttctgcctcttgcttgggaatctgtcctttccagcctgtaagtatggaaatgagtaactggtgagtctcaaagctttgaatgaacgtcatacccctgggcagacatgtgggccccctgaggaaagaaatgtcccttttcatagaaaacatctatatccaatattaaaaagcttacattagccattgggcacatgaaaaaaacattcagcatcactagtcattaaggaaatgcaaatcaaaaccacagtgagataccccttcacacccacgaggatggctataataaaaaagacagacaaacaagtgctgctgagaatgtagagaaattggaaccctcatacatggctgatgggaatataaaatggtgcagctattttggaagagagtctggcagttccataaaatgttaaacatgggttaaccacataactcagcaatttcactcttaggcgtataccccactcttaggcgtatacccaagagaagtcaaaggttgattgtagcctcttgggatatctcagccatcttgataatcagtgtccccacttttctctccccctcatttatttaatgttgtatgattccatttttaagctgctgataaagacatacccaagtctgagtaatttataaagaaaaagaggtttagtggactcacagttccatgtggctgtggaggcctcacaatcatggcagaaggcaaaaggcatgtcttacatggagggagacaagagagaaaatgagggctaagccaaaggggaaatcccttataaaaccatcagatctcatgagacttactcactaccaagagaacagtatgggggacacagcccccatgattcagttatctctcactgggtccttcctaccacatgtgggaattatggaagctacaattcaagatgagatttgggtggggacacagccaaaccatatcacatgccctattcactaacgataaaaatctgtccaagatgaactaccagctgcccacctctcaaccccttccactcagcctgcttcacccagttattctgtctgcctggccctggaacacttttgggtttgagatggactcaaattagagagtagcattttgtgggacatcacaaagggaaaatgggacactaactaaagccaatacccctgtcattggcagctatcagaaatgaggtgtgggcctcaaggcagagtcagagtcatggaattagaatagtggatgagaggttgggacctagatttcagcaaacaataatgaagggcaaaaggaaaacaaacttctccaacataaaagagaggagtcaagccctgtgggcctgatcaacagctggtccttagtgaaaaaagacatgagttttaaaaagagcagaatatgaagtttcaccttagatcctgggacttgatccttggaacttccgaaggtttttggatccttggaaacccttaggaaaagcagcaactctctttgaagggttttctctgttggcaattattaccttaaagtagaatgttaatagtcagccagaagccagttccaagcaatccatcagacatgtctacatgggtctgaactttactcataagcaaggctaaaattctgtcctatgggtctgttgggtcccatgttaaccaacttgaaagtatcagcgaagggatgacaggtgtcatgtaattctacatcctgatgtttccagctgattgattgatagaataatttctagtttcatttcttcaagcttttgtttttttcaatcaatctcttctcaaatccaaaggtaacttgtattctacaattcttatttgtctttcctgactgtataaatgtatttctaagatttaccacacacattacttacttatgtgtaataggtaaatgtttaaaatgtatttgtctgacagatttgaacatgcctcctctgtgctttctatttaccatgtattttctttgttcactccacaccccatcctatttcctgttttctcttcagatgatccagcttattttatgttttcgtgtttgtttttctttgtcgggaagttatatattgcctactattttagtagttatcattaaagtttttttatgtgcataatcatcttaacaaagtcttaaattaagcaacctgtctctttcttagcttccaaaaaaccttaaaattctttaacttggttttacccactttccattttcatgctacagcttctagtatcttatttaccctatgatctgctgtccactaaataaggcattgttattattacaattattacattttagagcaattttaaaagatttgccattgcatttaccaatttctttttaacattgcttcataatacttcttccttgttagatcaattttccatttttctgaagcctgtcctggtgaaagaaagaaaccatttgtgatttgtgctaaacatacccatcatcttccataattgcctcagcaattttgcagaatatgaattattatccccattttacaaattagaaaagaaaggcacagagaggaaaatgacatgctcaaacaaatcacaatactgatgtatttcagatgcagccagatattttgataaaatacatctttgagtggcgaaagaagcaatttgcttagagttaaatagaaatataatgggttcatcaagaaacaattggggggttgcagagtacttgtagacaggccaaagtgcttaaactcaagtgatttgtgcaaaagaaaaatccattattctgaaaaaattgctttaacagagaattttcaaagcataagagttgttacattcagcaagaaaaagggagggagtggtgagggaaggtaacgttatcacaatgactaacttgactttattttccccaaatttctaaatcttacagtttaagaggaaatgctttggggagagataatctttaaaatttgttcactgcattggtttttaaattttcaaaagcatatctgaattaaaggatggataagacactttacatcaaaattcactcagggctgatatgtgatgactggtgatgtttctaaggataacattatgaaattagttaagaacaggaaaaagactttaataattcattatcagtcattacctttggtggtgtttgttattgtttgtaacctgaagacctatagggataataataacaatagaaatgataattacatttttaaaaaataattcaatactaagcagattacagacaagcaacacgattagacaggcagcactcaagataattcactcagtctgttgatggattccacacttctcataagcataagattcattttcacaattaaagctagatcattaaaattgcagcctgttggcagtaacactttttgcagcccaaattctctttaaaacaaaacttgtagtcattagaatggtgacaatgtgctgaaaacacccactttggccttccctgggcattctgttcttcctggcttgcacttcaacaagttgacagccttattttgtaggcaactttagtagattgtcaactctggctaccacctatcctcaggtaggatggagcagaaattttattcccttaaaaaaaccgcatcttgcctaattcaagggactgttgtgttgaggattcagggtgcaggcacctgctgcccacaggcctttgggtggtgtgagaacaccagaatcaggttaccgtcactgagttgccaaaccacattctgattctaatgctggccagctgtgtgcccttgggtctttgactcaatctttctatgtcttggtttcctcatctctaaaatgaaactgcggtacccaagccctaggactgttaagaaggttcagtgaatacaagtgaagctcttcctgatgatatctcaagcaccttaccctattagtacacatgaatcttcctcattattggaaatgattgattgaagaccagttttatctcagaaggctgagttttcacatgaagacttttttattttctgtggtttagttacctctatacagtggtcaacaagaaagttgcaaatggaatcaaattcacaaaaatacatttcatgaattaaatattttcatgggctttgccaagggcacacaattaagctctgtgttgctcgatttctgggtgctcatgcatctgctccttcaaaacaggttagtgctttgatctgatgggccagtgtggacaacgatgctgggcttgtgagtggcctccgtacacagagctcctgaaatgcaagaccaagtaggccaaaatttcaggctgtatatgttcaaagctttgctaaaactcagtgtggcagaccttcagcttctactctgtaaaccctaaaggccatatagcagttaactgaatgttccagaatttccatgatgtgtttctgttcaaaaattcagtcttaaaatttcgttttcacttgaacttgacagcccctgaccttgtattttggagttggaaaatgtgaaccaatacacataatagctaattcccagtggggattctagacaaagaagataacgtactagagtgaatatttgttatctttgtaaatattatctttgtaaataaacaatagcaacacaaagttctataatgctgatgacttcatgaacaggaagaacagaggaagaagggaaaagggatgaagtcttctagcattggaccatccagtgttgtagtcaccagtcatatgtggctagcaagcacttgaaatgtctctagtctgaattgaaatctgctgtaagtgtaaaacgcacaccagatttcaaagaaggagtttgagaaaaataacagaaaatgtgtcattgataatttttgtattggtttcttgttgacataatattttgcctatattgggttaaataaatgatgctactataattataaacgatgctactataattaattgtattcacttttcactttttaaatacggccaccataacatttaaaattacatattcagccaggtgtggtggctcatgcctgtaatcccagcactgtaagggcaaggtgggaggatcacttgaggtcaggagttcgagaccagcctcgccaacatggtgaaaccccgtctctactaaaaatgcaaaaattaacaggatgtgctcacttgttcctgggaggcggaggttgcagtgagccaagatcatgccactgcgctatagcttaggcaactgagcgagactctgtttcaaaaataaataaataaataaataaataaaagtacatatgtgactttcattatatttctgttggacagcttcctttaatacacaaagataatttcctatttattgtatgtaaatagtgtcttcagcagaatggaagcaatttatacttatttatttacatatgcttgccaaaatatcaatttcccaaaaaacatttctcacgtagacctgaggtcaacctaaaccctgtttctgttccacactcacaaattatgaattagtgaattctaaatgaaagcaggcccaccacatttagcacatgagataaagaggaaataatgcgactcatctgtaagcttaagttaagtttggtttagaaaagcaatgagaaatgtgacagtcccactctttaaacagacaaaatgaaaaatcataagcaaaacaatctatgtgattgtatgttctcactcacatgtgggagttaagctatgaaaatgcaaaggtataagaatgatacattagtgtttgaggacccgtgggggaaagggcagggggtggtgacggataaaagactacacattgggtacagtgtacactgctcaggtgatgagtgcaccaaaatctcataaatcaccactaaagaactcagtaaccaaatgccacctgtttcccaaaaacctattgaaataaaaaaatcaaaattaaaaaaaaaacctatgtggatttaatgtatcattcaaagatgcttcagattttgatgacagagggatgtggcagctatttaccattctggtacctgtaagtacctacaggttttaggttttttatcctaggatgcttccttcattcccatgagatgtttcagtagagaggagccagcgcagcttccagtcagagctggagaagcgcagagactgtacagacagcaggataccctggatcaggctggattaagttgcctgtctctgttctctgcatctccaatccattgagaaccttcattgaaggaaattctcttcccctagcctgtgacattctgagcttattctgtgaattttcttcatgcctacacctctgtgcaaatgacagtaatcaagcaacctggctgtacagtgtttggggagaaaagcacttggctcaatgacatctgcagcctgctgcctatactgaattgctgtgtcctgagccaaggctgaggatgcctgttacaataagacctcttagcaagagacggcacactgaagacacagctctttgtcagaagcgatgaccagaggtaagacaacagtgttccagggcaccaaagctggcatattattgtacagccttattgttaaatgctcaggaaagtaacataaaatgttccagaaagcatatatatgatggctctaggagtcagtcagaggaagagattgggaaagggtggagcacaacagctttcaagcaaggaaggcagggtggaggtagctggcagtaatatcagcaataacactgacagtaaccactggcctattgagtacttactttgcatcagatactgtaattgcttcatgtgtattggctcatgtactttttataaccatcctactgttctctctattttatagacagagagctttggatggttgagtaagttgcctagtatcacatagccaggacataggtaggcagatctaggatacaaacgggagtctttctcactccaaagtctctgaattttccactgtgccaagaggacaggtcatgaatatattctatcctcttattcttcaccactttgagaaatttgtgagcattgcccatgtaattactattcatctacagctctagataagtggtctcaaatgagccccagagaacatttggcaatgcctggagacatgttttgccaccactggggtggcgggtgctactagcatcaagtgagtggaggctaggggagctgctagacattctataacacagaggtcagcccctcacacagaaaagtcttagccagccccaaatgtcaatagtgccacattgagaaactgcaccagaggaaaggcatggaaatcaatgcagaaccctatctcatcctgccccatctaggtcactccatagcttggttggtcattcattcattcagtcatatttattaagcaccaaccaagtggccaatgccatgttaggctctgtggacatacattattaaaacatcaaatgaagttattcaatatttgtcaaaagtatagttaaaacccatatgccacaggtctaagtagtatagaaaggaggatatttcagggaagtagttgatacacaaatgttttgagaatccaacatgctgctttacatgttttaagaaagataagaaagaagattaaaaaatatttacatatcagtgcatctttatttgaagttaaatctatacttagtctgtatcctgtcaatgctatgttttcgtctaactgagtttactaaaatgtacaaagagctttcctataacatttaggaatttgttttaatgtatctacaaagaatattgacagccttcagacttaagtgtcagtcattgaaaattatatttgctggagtgtttgttgtagaaaattacatttattcacttacaattgaaacaatggctgtcataagaggtgaagtgtgttcatctatcttgtattaattagcccattgactaaggcttccctaagcttgtaattaaccaagtctgtctgtgagaacagtggtattaagctagcaacacttttgagagtcttctttgcattgatttatgcaaacaaacatttaaaagtaacttgaagagattaattttgtaagacatctcacaatcttccacagcacaaggaattcaatagttagaaaaaaaaagtgtttctaaactcaaaagttaactgcttggcaagggaaacaaaaaatcaaagaaataatcacaataagaattaaaactataactgtcatggctacaaagaaagagagactcaaagtataaggagtaaacagaatggggaacatgacatggccagtggtgtggagttgggggaggcttctctgaggaagtggtatttgagctgagaactcaccaaagtgcagaagttattccaggcagagggaagagtatatgcaaaggcttggagtcagagacagtttggtgggcggtgtgcctggttctaagggagtgtggacaagtgcagtgtctgatagtcagaagggtaggcagagcttgtacattgtgggtccaggcaggccacattactgggtttacttcttttttatattgacatcaatgtggaataatcaaaatgccaaaatcaagaaggcaaaatgagaatgttcattttgagaagctcactgggcaatgaatggatcattgcaggagctgagtaaaggcaaagagaccaactagcagataattgtgccaaccagtatatagataatgatggttggaaataggtcaatgacaatgaaaatggggaagagtaggtggattcaagagaaatttgggaggtaaaatccacagggctttatatacaatggattggctatgatggcacgggcgagggagatggaggtgtttgttaaatactttttattgggcttaagggtttatatctcatacactggggacagcaaaaacatggctgatgttatggcagaagtttcgtgagcacctgcactgtctcctatgaacaggaaaaagggaaagatcgttctattcccctatagtggtgtacagtattaccaggtgcctaatatggcctttaatatagaggaaaagaaccatcagctctgcaacaggaggggaattctggggcatctgaatatttaactcaaggaattcaggccctgccaaatctcagtcacaatgcaaacctttataccccatttccttctgtgccaataatgacatttggaacaggagggagaagtctactgaaaagcaagatcctcctcagcaagcacattggtcaatccctgctgggctgtctgtttcagctattaatttgcatgggctgcttctggactgattctgtgatggatctgttgccaagatcagccattaaaagcttacttgcatttctgctttctagacatgtcatatcatgaggccaagaaagagtggacaggtacataagctatggcctgaaatggaaggagatgagtctgttgccaacagccaaggagagtagtaggggtgactagaggggaggggaggagtggaaatcaggtttgaaagagacaaggtctcaacctgagcccaggcaaaggacagccactctctaaagtgtggcagcatgggtttctagaagaactttggagtttgacctcggctcatatcccagctctgcaagaagtgagcttaaggcaagtcatttcacctctctgaaccttggtttcttttgaaaaaaaaaaaaaaaaaaaatggaaaccatcctgtctactttggatggtggtgagaatgaagtgatgttgccacaagcattgggaagcctttggcttggctccaggtctgtctggcaaacacttggttttaaggaagtaaaggccacagatgtaagcctaccaccatgcttttgctcactgacttcctcccactatcctagaccaaaaccatatggacccctaaatactgacagtcttgagttcaatgcattatctgaatcagtcagtttctccattgactgaaggcaaagtggctgagatagacatttggatggaccttcctgtataatgtaaacctatctctctgaatcagctggtgaggtaatggggtgttagtcacatgcacactgagttgttagggaatattaaatgacatcactccacttgttattatttcatctgttaaaattaggtttctgcctgaaattgcttagtgacaatactcctggactttcttcaaaagctgtaaagatggcctctcgaatttagaaaacgctgaaattgttggaaagttttactaagctgtttagaatttaaaacagcagcttccagcaaagcagttgagaaataaacagcatctcagggtgttttccagttccttcatgaggcaataactcaaaatcttgtcacatttggaaaaggagacagatcaaatgtctaaacattctaagtgtcttcaaagaaaatacttctccctctggaacagtgagtctggtattaaacaacatgattgcttgatgagttttatcatggcgtcttagacctgggaaatatcttacaagtcatgtctcagtctttttcccaagtcaatgaaaatgtcatttgctttataaagaatgggtatttcacaagtttcccttgtaaattttttaaaggctaaattcattcattgcaaggaaactctggtagatgtttcattcccatttttcactttcgtctgcacctgtcctgtccaggtattagaagagacaatcactttctcatctgagaagatcctcccttctttctgacatggtcaggttctattttatctcaaagcttatcttttttataacctcctttgtgagactctttccctacctttggggaaatcacactcctacttgtactaagtaatcttgcaacagtgtctatcccctctcatcattagtatgtgtgtccttgaatgagtttttcagtgtacagtcataatcctttgaggtttcaggtggacaattagtcctggctattgacactacaatgctggaaggtactaaggagattgttaaagcattctcactttactgctgaaataaccaaaggccagagaggagaagccatttacctatacatacatggtgacataagtggagcacatactagaccttctgactttcaattcagctttttttcagctatgatgacatgtcaataggttcgcaattggcccctggttcttcagagacattcagtcagttcttattgagtgaatagatactgaatgagtaaagaggaacattttcttaggaatttagttttaagtacaacatggatgccatgtcagatgaaagcactcacaacttcgtcatagataaatgtttatggaaggccccagtgatgggattgaagggtctcatcctggaactgactggagatcggtcaggaagaatcaggaagaatctgattctatttggattccaaatcttgtttgccaggtcatgtatgatgtgaattcagaagtcaattaatttactaattcagtcaaagccaatgattctggaagaggtgaaatagcattattggagttgaggataagaagatattttgaattctcagtagctcaaacttgccaggggcttcctattctggcccaggtaccatcaccttgggaagacttccttgtcagctgccaaaatctcacttcttccttggcccctgagaatccatcccttgctccaatagccagagctactaatatccccttacctcagtgcagtcaatggaagtgattggaaactctttcctctacttacataaacacctgcctcaatacctagcaggtatctacttctgcctacctagagagaagtggatacatttctggatttgtcagaataaatttaaataaggctgaggatccattcatggaatcttgtccctctggtgatcctcaaagcaattaacaggggggtataaaaagtacttggatctttgtgagcaaacagagatgctcagtgtaactgtagcttgagtacaaagagtaaaactgtttaatttgtgctgacactctagagaagtcaagggtagagagatgaccgttgtgtgagataggaaaaaacaaatcatgtttcttactctcatactcaacgcagtacacagaacacttctaacatcaaacatgtaaatttttacccacacattaatcctctggcagaacacccactaggtgtcccgaaatttaattaaattctgactatctacatttagttagactcagatcccataggttaagggatcagtcccacaggactgctctgacccccccacccccgaccaaacttcagatgccaataacaaactcaggcctcaggaacatcaggctgactagctatacaggggagatttccacaactctctcctcggcttccatcatttgctagagtggctcacagaactcaggaaagtgctttatttacactcattgatttcttagaagaggtattacaaaggatgcaaataaacacccagatgaagaaagaataggcattgaacttcctccaggaaatctccatgctttcagccatacagaagctctcctatagcttggggattttacgtaggcttcatcatgttaggcatagtatattattaactaaatctgcagctccactccctttctcagaggaagggagtggagctgaaagctccaagctcataatgatggcttggtcttcctggtgcccagtcactatccaagagcacaccaagagatgcctcagaacagaaaagactcttattactcaggaaatgacaagggttttaggagttccgtgctatgaactggaggcagagaccaaatatatatttctcattatattacagtattacagccatgttaatggatggatgaatgtgtggatggtttagacaaattgttctatgaacgaaagcctttcttgtatcaacacagaacaactgacttgacttttcagaattatgagcctaaataatttattaaaggctaggaagacaatgaatttgcttaactcaaacttactgtctttcctagacaatttttattctcttttacttctagaaattatatcctatcctccatgcccttataacactctgtagtttgctcagctacatttatgtctttatggtgacttgcccatctgttttcatgaggctgtgagctccttgatggcagagactgtctttttttctttttatctatgtgttattatcgttcactttttgttttaaaataatttcagaattatagaaaaaatttaaaagagtatatgacctttacttagattgtctgcaaattttaaaaatgtactacatttgcttaccgttctatctttctatctacctatcacctatctacacacacacagacacacacacagacacacatacacactttattatgaaatgtttaaatgaaggttgcacatgatactcctttacctctagatgtttcagtacgaatttcctaaaatcaagggcatcttcttatgtaatcacagttaaatgatcgaaatcaagaaattaacattgattcagtactattaactagtcaatagaggccttattcaaagtttactagttgtcccactaaatccaaggttccaagtccaggatcttatccacactcacaggttgtatttagttgccatgtctgtctaatccatcatgtccttttgttactcttgaatctggaacagttcctcagcctttctttgtcttttataaacttggcacatttgaaaaggagagaccgggtatttagtagaatgtctcttaatttgggtttgtctgaggtttcctcataattatattcagaccatgcaactttggcagaaaaaccacagaagtcatgctgtatccttctcggtgcatcatatcatgaggcacatgatgttgatttgtcctgtttttttgtgatgttaactataattgcttcattaaaagagtgtctgccaggcttctccactgtgaagttactatttttctctttgcaattaattagtatcttgtggggaaatactttgagactatgcaaatatcttgtttctcatagtactttcacctactaattttagcatccattgatgatccttgcctgaaacaattattactcttgtggttgccaagtggtgattttctaatctcatctttccttctatatttattagttggaattctgacatgtcttttccatctgtgtcctcattgcttaggtcagtctggtccaaagaaggtattattttgtgtgagttgttctcgttagttgcttagtgttattataaaaatattacaagcaacatcattgttttaaagaagaaagcaggcaaacatggtaaattgtgctattcaataaactttatatgaattgtaatttaaataggtcttttaaaaattagcatagacaaaggcactttgtaaacatcatcagaatacataaactgtggtccaaaaccccttacataaatgagacaagtctccaggataaagccttccatcctctctcaagtgagtgggtgtcagctgtctcggacatagaggactgagtcatacctgagactatcctttgcttctgggtcagcaagttacccagaagaaacttaacattgtgatgacacacttgagaaagattggacagttttcacagacagtttcgtcttactctctgttcttcaaattttagtttttatttctccataacacaaaaacaatggggcaaatttatttgctgctcctagaattctttgaatttcaagatatggatatattgttacatttctatatacatggtaggaccacaaaaagggttaaataaaagcattacatagatactacttactcctcagggtcctacagacatcttctcccctatcctgtttcttctttctcagcctccttgtgcagcgtttctttgtcctaaacttgaccttagctgctgactagtttctcccatgactcagccaaaatactgcacaagcctttaccttcagtcctctggggttttgcatctgggcaagtggctctcttttctgggcaagctctgatctttcttcctggaaccctccactgccacatctgtcagtttgaggtctctgaccccatctggctttcctcctgggacactggccctctcccaaggacagccagaactcccaagttaattatctagagtcatattgcttccctgtctatcctgacttaaaagggggaaaaatcctgcttccttttggttctccagaataatttagaacttttcagaaagaattacaactataaaacaaggataaaacagagacaaaaaggttaaatagaaaaatagtttttaaagactccaaagttcatatcaaatttagttttaaatacagattatattaagtggcctaagttagactactaggacccacagtactgatcactacaccatccattaattttatcttttagggaaagcccttgggtgaggtgacatctgtttttagttttaaatatttcttggtcccatcttatggaaaaggaaccaaggtatagttccacaatctcatgaaactcccaactcgatgaggatcaaggctatggctgtggtattcacagacaaatcttctgaggctcatataaagtctgtagtagagtaggtaatccaatgatcatgcacttaaattttctcaaaacattctcccacagaactttagcaaattcctgaatttccagtatttaggcaccagaactatatcttccaaactgcagaattagaaaacaaagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatcttaacgttggcctgccttgctagatgggggaagttctcctggataatatcctgcagagtgttttccaatttgtttccattctccccatcactttcaggtacaccaatcagacgtagatttggtcttttcacatagtcccatatttcttggaggctttgctcatttctttttattcttttttccctaaacttcccttctcgcttcatttcattcatttcatcttccatcgctgatcccctttcttccagttgatcgcatcggctcctgaggcttctgcattcttcatgtagttctcgagccttggttttcagctcctttaagcacttctctgtattggttattctagttatacattcttctaattttttttcaaagttttcaacttcttcgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtatgcccctgctggggggtgcctcccagttaggctgctcgggggtcaggggtcagggacccacttgaggaggcagtctgcccgttctcagatctccagctacgtgctgggagaaccactgttctcttcaaagctgtcagacagggacatttaagtctgcagaggttactgctgtctttttgtttgtctgtgccctgcccccagaggcggagcctacagaggcaggcaggcctccttgagctgtggtgggctccacccagttccagcttcccggaattcaacaagaagagctaactatcctaaatatatatgcacccaatacaggagcaccaagattcataaagcaagtcctgagtgacctacaaagagacttagactcccacgcaataataatgggagactttaacaccccactgtcaacattagacagatcaacgagacagaaagtcaacaaggatacccaggaattgaactcagctctgcaccaagcggacctaatagatatctacagaactctccaccccaaatcaacagaatatacatttttttcagcaccacaccacacctagtccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacataacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatgaatccaggagctggtgttttgaaaggatcaacaaaattgatagaccgctagcaagactaataaagaaaaaaagagagaagaatcaaatagacgcaataaaaaatgataaaggggatatcaccaccgatcccacacaaatacaaactaccatcagagaatactacaaacacctctatgcaaataaactagaacatctagaagaaatggataaattcctggacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaacatccttgatgaatattgatgcaaaaatcctcaataaaatacaggcaaaatgaatccagcagcacatcaaaaagcttatccatcatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatatttgttggaagttctggccagggcaattaggcaggagaaggaaataaagggtattcaattaggaaaagaggaagttaaattgtccctgtttgcagacgacatgattgtatatctagaaaaccccattgtctcagcccaaaatctccttaagctgataagcaacttcagcaaagtctcaggatacaaaatcaatgtaccaaaatcacaagcattcttaaacaccaacaacagacaaacagagatccatatcatgagtgaactcccattcacaattgcttcaaagagaataaaatacctagtaatccaacttacaagggatgttgaaggacctcttcaaggagaactacaaaccactgctccatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaagctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatccattccttacaccttatagaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaacgctcatcatcactggccatcagagaaatgcaaatcaaagccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatgtagaactggaaataccatttgacccagccatccctttactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcgtattctcactcataggtgggaattgaacaatgagatcacatggacacaggaaggggaatattacactctggggactgtggtggggtggggggaggggggagggatagcatcgggagatatacctaatgctagatgacgagttagtgggtgcagcgcaccagcatggcacatgtatacgtatgtaactaacctgcacaatgtgcacatgtaccctaaaacttaaagtataataaaaaaaagaaaaaaatatattttcagataatttctaatggcataaatggttttgcagagttttgaaagccagtgtaacttttagtagcagtttcttatgtacagataatcaactattaataaacttcatttaaataaagtaaaaaaaaagaaaacaaagtcatgtgcaaaggaacaactctcaattggaattaaaaacataacaattgttacagcaacatgggtccatattagctagggtaaaaagcctggtatctaaccagtatgttccttgcaacattttggaaggacacagggaagggtatagcttattgtgcataaaatctgtagacccaagatcaccaagaattgagtgaagacaagtggaaatatggaagcagggggtaatatggtgaatagttgtcttggataagcttgtcaatgatcatatcattttccctaaaagaaatcaagcctttaattactttataatttttatataaaatttgtttttctcttattttgacatacaaatgtggagtcttggattagacttgctgacactgagactttaggagacaggttcagtagctgaagtttcctcatctataaaatgggcacattacttatcatgtaatgctgttatgaagattaagtgaaagagaaaatatcttgcatgaaaccagcctatttgaagaacatgctactatttcactctttcttaactttgtccttctgtctggtggtaggcataattttaataacagccaccaagtttccataccctaatatccggaatctatgaactatcacctccatgattatcttacattttaatgcacagttaactttaacacagaaagattatctgcctaatctagtttcacgagcccctttcaaaacaggattttctccagctggtaacagaagaggactgcagagggtgtcagagagattttcatcataagaatttgatggtagcctatcattgttggacatttgggttagttccaagtctttgctattgtgagtaataacctaaaacttaaagtataataataataataataattaataataataataataaaatttgatggtagctttgaagatggaggggcatgatgagacatgagaagctgaatggtccccatctgacagccagtgaggaaacaggaacctcagtcctatagcaatgaagaaatggattctttcaacagtctgaatgagctttgatgtaggttttttccccagtttctccagataagagcccagcccagctgacactataactggagctttgcaaaatactcagcagagaaacctgttgagcccacctggacttccaaacttatagaactgtgagataaaaatggtgttatttgaagccattaaagcttatggtaatttattatgcagtaataagaaatagataaacatcctttctttccttctttttccattaataaacatttatttctggcatagcatgtgcagggtacagcttcagacactataaaactcagggcatttaattctccaaacatctctaagaagtaagttttaatatccccattttcatgtaagggtgaacataggggtataaattttggacactgtctggactttaacccaaatcctattgcaacattttgttatttccattttcccctctttcctacaggattcaaattttcctctgcccaagtggtcaaggggggcagaaggccctaggagaaggggggcagtgaggcacgcattactcctgaggtcgttatggagatagtgcaaattggatgccagcaccatgggtcacagtggcacttggagactttaagaagtcattattattgtcaagcttgctccccgcatcttcccctcaaattctcagaattgaatttggcacagttagccagaaggcctggctctgctttggagtgcatgaaaagggattatgataacaatgataacaattaatatttaataactatttattctgttccaggcatcaattaatcttcaaatctaccctctgccttggccagggtgctgctgtgccaagccttattggtgcctgaggcagaaggaaaaatgtatactctggctataatggaagtaaacacatcaacaatattttcaaaatctacttcattgctagtttcattttcaaagaagagaattgtcatactgacaatttctcttcacccagtgacaattttgaatacattttcattaactgaagctaaattaaaatgatcataaatatatttgggtatatatactatacttaagctgagaataatgtttattttaatacttacatttcatttttcaatattttttcaactattttaatattctgcaaaaaaccactaggaaaacacataaaaatatgtatagaaatgtgtgcatgtacacacacacacatgttttgcctcaggctcaatatggctaaatagatcaacagtctttatttaaaattttgattattttcatcatggattttttttgcataaattttaatgtctaaaaatatattgtattaaattattatttaccgtgattactgagtttcttgacaactcctttaattttttggctgagtgacttacttatcctagttttggcccttgttcagagcaaacacccagcttctcccaaggggcttagcctctctagacttttctgtacattgaagaagatccaaatattgactgccttattttccaggcatgtattggtgaatttagacatttcaaagtctcaaagtgtctcatttttttgacaactttagcctgtcctaggttatgttacataaacatagggctttgcaaagctttcgtttggaaaaaaaacaaaacaaaaacttacaaaaactgtagctgcacaaatatagcaagaattgtaatgctaatctgagatgtattcaccctaatattgagaggcatctggaatactgctgggggccaatgtacatgcagagtaaaggaatcttctgggagagagagaagggaggtgtgcaattttctacaatgagtaagtgttaattgtttggccaacagtgtctttattgctctggtaataatagaaaaaagcagtaatacaaatatattctgggtcataaagatcactactcttagttttacttttatttcactatacttgcatttgtgttttaatgcaagaagcccagcaccctgccccaccaaaataatttaaaaaaaaagataagagatcttaccgaataaatgaggtgttcattctaagtgaaggtcagtggatatcttcaattcatttgtatgaataaagctttcatagcagttcaaacaggcaaacagcgtgaggggatggggacaggaattgaatcatggcacagtgcaccatagtatgggcttgtcaggcggcaaagatactgtaaaaatatagctatcagtgtcatgttcagatttcaaatggcaatttaatttcaggaacacaatacaagatgccacactgaattgatattgttagttcaaatggaatggttattattgttttgtttccattgaagttgtaaatgtgttttttgctatagtcatacatgaaccatgaagataaacagttaatatagagctttattttatatactttgaagttatattatgacaaataatttatataaacattggacatacaggtaattttttttcccttcaaaaaggccattatgccacccaagtttaaaagcctggaactctaagaagtgtcccagttatttagagaatatgtgggatgcagagagaaggtggtgcttaatcctgaggggctaatagcttgtcgtagtgtctcttagctatgatggaggagatatttgagagccttaagccttctttacactttttactcataactgcagtctttgcttcatgatgaagctaatctgagcaactctatagtctgttcacaaagtgttagagcaaagttagaaccactcttgcttcctcctcacatcaaacagcctaatgagattgttagcaacattgtgagaacctgttatctttacatctcagcaagaaggtgtgtatgtgcgggtgggcatgcccacgtgtggatgaggtgtggaattgtcactgctgttgcacttccaaattctgggaactgtgaatttggctgggcagggtctgggcttccagccagctgctaagctgtccaggtagatgacacactaattaggggaattgcaaaccaattagcactttggctggattggctgatgtgtcttagcaacttcttcactgaatgttttgtgataagaaccagtccaatgtgcctccctaaacccctcaccatctagatgggttatccagtctgtcctggaaaagggaatgctttagccctagggacattattaatgtttcaatcctaaactgtcagcctttcttcagaaggtagcaattctcccctgagagatgactatcatgctttggggctggtgggctaggccagacctgcactgtgaagaggagaggcaaaaaaagaaaaagaaaaaagaaaagaaaagaaaagaaaaaagaaagcttgcctagagggttggaaggtcagtagctccctgttgaacacattaatctgtatggtcattgtcagcttggatacagattccagaattggttttatttttctttcttcagaagcatccttgctctcagccttctgcagactgcaggcacctagcctacctgccctcttccctgatagctctgcctctcatcttcactggtgttggttccctacaccaaccctgccctgttgacctctgctggcctcgtagcagagaaggagagggaaggctggggaccaaggaggaggggaggcacttctacaggagtatgttctgattaattaattttttcttttgtattctaagatgctattaatgcacccaaaggaaattgtttacttctaaatggttacaacacatagaaaagtgtttctcatttttttataatataataacaactatactaatttcttagtatatgacagcttctgagtggccataacaattttttaaaaaggaacaagggattatgttctagtgtcctcatcactatcttcctttataggaaaatgtgactcttagagcagtaatcacctctgggtgcctgattcgaatagttccctatgtgtatatgatgtgtatgtatatgtgtacatgtgacacagaactttcagtctaacctctagcatgtgagggattccatcctttccccatacataaagaaaggtgattttaaaagacctttttgaaaatagactaatcatagagttcagaacaatgtttccttagttcacggtttgtgtgcatgattataccaatttggtctcccttattcaagaaggaacaggtaagcaaaaatggtgtgtataattcaaaagaccattctcaacacactttctattggcagcctcagttgttcacaccttagcatctctacatgtctaggcaagcccggagagcttagcatggttgggattgggactttgaattgggaatacaggagccacttgggatggaattttctctaaacgtggtttatttcatttaccagatcttatcaattaccagtgaatctacatattaccatactgagaaacattctgaggagtgttgcaaatcatctataaggaatgcagaatcctttcaccaaaattgtcattgaggcaggagtcaggggtggtgatgtttgcaatctctgccttaaggaccagagaaagtcaacatacacaaaattgattaatgggtgagacagcatgattggcttttatcctgcaccctttcctgtctccacacacataccctggcctcatggatgcagtacattttcctgactcttgactttggagtagtcacgtgaatctgttttagccaatggcatatgggtaggagtcatagtgggctgattcagagactagggcaagaggcctcctctgcttccacttgctctatgtttctaccgtcattgtgagctaaacatgccctgactagccccatggttacaggagattgaaagacagagcagagatcaactgaactagccattctgcagaattgggagactttggagatggtttgttacacaacagtggttaataatacagtccacaaatgaaaccttggttactaaataaatgtataattgtgaatacagaagagtgtcattttcgcaatggagcacgaagaaatttacatctgagtcccagggcaagcggactgcaagcaaacactgccaataaaaatggcaagaagtatttcattaataaattataatagagactcaaaacctgctactgccaggcaaagcaggtttttagcccatgttgtgtaatgtcatacttgtagaggtaggtataaggatgcattggttttggaatatgtctataaatttttgacactcctaccaccaagaggtggattttaatttccttcctcttgattatgttccagccttagaagttagaaattacttgcatctaacaaatattatacagagcaatggtattgtatggtttctgaggctaggttacaagagataatatagccttttctctctcttgtaggcacccacacccttggagcccaaaaccatgccatgcacatgtaaccaaccagctacatgtgaagatcacataaaggtgttcttgtcctggctctagctaaggttccagctctcagtcagcatcaattgtggaagatgggagtgcatgagcttttagatgatttcagtcccctgcctttgacaccaagtggaactgagatgatctttccaccgagccctagtcaaactgcagattcatgagcaaaataaacaccatcattactgaagcaacatggcatgtggggtgatatgttggggaagccatagataatcagagaaagctccttttctttgtgagcaatattatttgcataggagagagacaaagctgcatggactggaaacttccatgaccaaaaaagatgtcattttctaagggcttgagtgggaggtggccctgacagcatctgcatgagccagagatgcactcacactttcattattgcttgagggtgccaagaactgtagcagtaagagcagaagcagaaatgaagaacacgaaggatgctatggagtgagagaaaagtccatgcttgcaagaatccaaagacaccctgtgaggacgccccaaaatactcgaggaagtgtgtaagtagagctggacctttcattctcccagctggggtagaactggagccatgtgtgcagggcctgcttcttcttcagggctgccgtgtcctggaaagccaagcttgcacatgggttatagcactccactttcccaaagccctcatatacatcatctgtttcagtgctcgcattaacacctgtgaagtagatattattcccaggtctcacagcccataaatggaaactctgccgggaaataagtcctgcttttctctctgtaccagagctgccccagcaaattaaagcttattctaaatgtaggtacctagagcatttcttaaattaaacccagagtgaattctgaacctcagtctaagcctctactgatttgtctattctgtgagttcagagttctgcatagtaaaatctcattaattcaatctccatgaatgtagaatttggggtaggcatcagaaagcagtctctccttagtcacttagccacacttactttggcccaatgacccaaaaatttcttgttaaggcctttctttaaaatgatctctaaggcaggcactttataaatgaaaatcacgcccacctaagcctaggcttgcaggtttgtctgcctcgggctttcaggtatgtctggttctcttaccccatcaaagggacagactgctcacaggtgcttaagatcatcctggcatggacccttgttttatgcaaagtgtgtgccagtgctggatgtgaaaacaccagtcgattcccattcgctggtcttagccagtcagaaccttgcttctgaggcagggtgatactgtggttacttctctcagatttccctctaatgtttggaagttcctatacaccatactgtttttgcattagccacagatgtaggctgcaaatgtctactaggcagcatgggctaaccaaaataaggacacgattgacccaaccttgtcattcttagagacactggaaatctcctcaagttggtaataactagaattttttatcaaataatcactgttttacagataaagatggtgcctccacataaactgaacatatggccggcaaagagcacccctattccatcatccaagttctccttccttagctgaagtgaaaacatttgaaattgatgatacaaagtgctggggagggtggagagaaatggcccctgtctaagctatatggagagtgaatagcaaggcagtttgccaatatctatcacttgttaaatccacatacactttgctccaggaattagaatttcaggaatttatcttaaaactgttgtaacaacacatatatgaagaggtttattgtagccttgcttacagtgactaagtatcagaaacaacctagataactgtcagtgggaactggttgaataatttgttttatcaacatgtaggaaaatatccaatctctatagagaatgaggcaaacttttacaaactttgtaagatgtatttctaagtaaaaataaacataagaacaaacaaatgaaaataacaatgacatgatttagaagagtgtataaaataaaatacaaaagacacacacatacacaactcagcattacagtgaaaattttggaaagataaaatggaaaccattataatggttacagctagtattctggtaaaaaagaaacatattttcaagatactgttcagtaccatttgaagtttttatttatttcatttttaaaccatgtattacattttttaaattaaaagaaagcaaaagctaaaagcaatatgaacacagaaaagtcagtatgaggttgtcgatacgtaaagtttgaaagtgcagacttttcaaaatggcatcacaggaaaactaaggaatatatacattttggacatcaaattgcatcccagcacggagaatatttcttgaagaaagtggctgggtttgatttaaggacttgagggctggggtattttgccacaaaactctatttttttctttcccaaagtgcgtgtgaccctggggttaactacattcaatgttttatcaactcaccctttcatacactctgctatactattttgaaaccaaatttaggctactttgcatcagccagtgaaaagccaatttcaaattgacacatatgttgttgttatctgctggtcaacggttctgttttagcaggttgtcatctttgtttctgtttttgtgatcttgttgcttttatttttgagactattattttgattctgttgcccaaagcttctctagaaaaaaatttcacagggagggagcagctgccaagatccacaccttcttccctccacaccaactcactccatcatcttcaacaactgccaacctattcatcctgcttcagttggaagagctaaactttttgtttatttttggattcaagataaaattttattcaaaagatggaatcctgtaataaaacactcttggaaaataatctttaattgcagtttgcatataatattatttcaaattgaatatgatacagacaaattaaacggctaatgccagtgttaaaaaatgcaagtttcctaaatgtaatgtaattgagataaagacagtatttgttaggcttgcaaagaagagactatttaagtagaagtatgaggtagggctaagcacatggcttttggggccagaatgcctgggcttagaccttagtgctgctaattattggctatgcaaacttgggcaatcatttacacattctgtgctctgcatatatgacatagaaatgttcctggtgctagtgatatcacatagctttgttatgtaatttaatcaattacttgaaggacttagaccatgctcagtgcacagtaagcattatataaatattagctactgtcattacctttaatcaggtgctccttattaggcttaatactatgttcaaaggttaatatgcatgaaatattggaaacatattaatattatttggagttttataatctactttggctttgggggaaatgaatcactcatgatatgaaaatcaataattcaacttctacacatttaaattccatatatattttcaggacacactaaataacacattagaagcctttctgctcaagtatcttagtcattttctagacataatttacatacagtaaagtccacaaatcagttatacagatgcagacacctatgtaaccaccactcagaacacgagagaacatttccagcaaccaagaaggctcccacctgctccttctcaatcaatatccctaaaacagtgaaccctctgacctctaccctttaattagcttttcctgtccttaaggttcatataaatgagctcattcagtgagttctctttgtgtctggctccttttgcttggcaaatctgtgagtcccatcaatgttgtatgatagactacaatcatttgctctattctgttgatggacctttgagttgcttccagtttggggctatttgaattaaacatttttatagatcacgaggtcaggagttcaagaacagcctggccaacatagtgaaaccccgtctctactaaaaatacaaaaattagctggatgtggtgacacgtgcctgtagtcccagctattcaggaggctgaggcaggagaatcgcttaaacccaggaggtggaggttgcagtgagccaagaccacaccattgcactccagcctgggtgacagagtgagactctgtctcaaaaaaacaaaacaaaacaaaacaacatttttgagcatttttgtacgtgtcttctgatgaatacacaacttgcatctcttgaggagggagatttctgaatcataatgtaggcttttgtttagcacaacagcccaccagtttttctttgcatttcgtaaggcaagttgcaccattcttgtcccagattggaggccaacttttcttcagcaatgtggcagggtggcctgtactatgggtgtattagcctgttctcatgctgctaacaaagacatacctgagactgggtaatttataaaggaaagaggtttaattgactcacagctccacatggctggggattctcacaatcatggcggaaggcaaatgaggagcaaagtcatgtcttacatggcagcaggcaagaggccatgtgcaggggaactcccctttataaaaccattggatctcatgagacttattgactatcacaagaatggtgtgggaaagagccacccccatgattcaattacctcccactgggtccttcccatgacacatgggaattatgggagctacaatttaagatgagatttgggtggggacacagccaaaccatatcagtgggcaagttcaataagcaatgaatgcttaagtacccaccagagcactgaagccacagaggtaggaggaccaagaataggcatcttggctggtgacactcagacgtcaagatccaaatctacagtttctatagaggaaagcttccactggcagccaggcccctgccttcagggatgcctcaggccctgagagttcacctctttctcctggcaatgtcaagttccacatttctgagccaggcagaggaaattatttgtgaatttatgacagagaaaatattctttaaacagaatcttccctgattattggagcaaatttggctgctaggaactgcttctccctattagctcattgggaacagaggggagagcctctcactctgcttaaccccctatggctctgttccttgccagagaaggggcccaataaatgcttgacaagttaaatggaaatgatttttccccttttaaatgtctcctcactatggcatgtcatttatacaggacgaagcttttattacattcatcctctttcctcctacctaatcctcttgtctttcatcctccatccacctgtcctattgcatttgggactcaacatgtgacatggaataatagtggttaaagcattagtttaagggccaaaatgcccatgttcaaaccctgttctgccccataatagccactagatctttatcaaataactgtactatatcacaattttttgtgtaaataaataagttaatatatatagaagtgcttagaattatgctgggttaaggcctacataagtgttaccaaatattatgtgagaacctacaggggaaaaaaaagaagggaacctctgtttagccagagttcctcctctatagaggtcttctactctgaaaacatcacccttaattattcccaaaacagtctgcaatagtgaaggataccaaccagtaatccctcatgtctaattatacccttaaaacttgcaagcaccttatattcagaatatatttgaatgcttacagaaaccttttgaaaaagaagaagaggtagtatccctattttgcaggaactaaagttcttgggctttctatcatgcaaccatctaatcactcattcacccattcactgatatagagattgtgttaagcccctcccaatcccagtccccatcccccgcacactgtgtgctacacccagttctcctgcctggtcagccagagcccaggtcttctaatagccatcctgctctagtcctacccaccagaccccagccctctgtgagcttttattcgactactcacttctccatctctcttttctacctcttcctcatccagactttcatcacctgaacatcacattcactgcatttaagttgaatggcttcctaacttaataacttacataaaaattatgcattttattgtatactatgtgtttaatatttagcagaaagaataacagatagaaaaaatgaaagagtaaatgaaaatacagatatacaataaatgaaaaagagagtctatattttaccactctggataattgctatatctctagagcagatatgtatatgtgtatgtataaattttaacaaaattggtattggaatacacataacattttaaaacatacttgtaaactttaatatctatctttccatgtcaatacatatttatcaaccaaatcaattttaattgactggacaatgttgcacagtatagatatccattgcttaatttgacctgttattgaacagtaggttatttccttttatagaaatgttttgctagtataaacaatgctaagataaacatccttgtatatacttttatgttcatatccttaatgatgtactttaaataaattctaactggtgacactgcagtcttatttttaacacttttgatagcttttgtaacactgtccttcagaaagactatgctagtaaaagggtacccaccacatgccagcactagtaagtattatgtaaaacaaataaaaataaaaactaggccaggtgcggtggctcacgcctgtaattccagtactttgggaggccaaggcgagcggatcacgaggtcaagagatcgagatcatcctggccaaaatggtgaaaccccatctctactaaaaatacaaaaattagctgggcctggtggcgcacttgggaggctgaggcaggaaaatcgcttgaacccaggaggcggaggttgcggtgagctgagatcgcaccgttgcactccagcctggagacagggcaagactccatctcaaaataaataaataactaaatataaaataataaaaactttatcagttggatagaaaatgtataatctattttaatttgcattcattttgttaccaatcaaaatgaatatgttttcataatcttattattttgcaagtctttgcccatttctttatatttttatagttgatttataagatctctttttatattgaagataataaacacttatttttcacatatacggctgatactttctccatttgaaaaaaaattttgtgcagccatgcatggtggctcacgcctgtaatcccagcactttgggaagctgaggtgggagacttgcttgagcctaagaattccagaccagcctgggcaacatagcaaaaccctgtttctccaaaaaaaaaaaaaaaaaaaaaaaaaagctgtgcattggggcattgcagtgtgcatgtgtagtgccagcagctacctagggggctgaggtgggagaatcacctgaaccaaggaggtcaagactgcagtgagctgtgatcacagcactgcactccagccttggttacagagtgaaaccttgtctcaaaaaaaaattattttatgtttagttgctaattttaagagacttcaaatatttacgtgtcagttttagtcattatgttttccagcttttgtgaaagacttaataatgtcttttctagcccaagatgtttttatagtttcactttaaaatttaactttttaagatatacataatttatattcttttatagtgagacataaaaagctaacttcttctctgtttgcttagccagttctctctgatctgtggttaaaaatccactgccaggcagagtgtgatggctcatgcctgtaatcccagcactttgggaggatcgcttgagcccacaagttcaagaccagcctgggcaacatagcaagactctgtctctacaaaaataaaaataaaaactagctgggcataagtgtgtgtgtgcctgtagtcccaactactcaggaggctgaggtgagaggattgcttgagccccggagttcaaggctgcactgagcagtgatcatgccactgcactccagcatgggcgatagagaaagtcccggtctcaaaaatgaaaaaaaacaaacaaaaccctttcatataatatcactagttgtttgaatgctggtccatttagcctgtgacagcttggctcctcttatcttcctccttcctgtttctctcatcccttcatcttgggctccctcttcacgtagctttccacctctcctagaaacccttacatgttcaagcctttatgtcactgcatacccaagtccctctgccctgcagtgacttctctccactctcaccctaaccccttctaccaagaaaaccagacatcttttaaggtttacggaaggtgctacctctactctgtgccctttagttctccagatattaacttcctcctcagggttctcacaggaatccatatttctgttggagccttgttctggtgaacagtaattgacagtggactttgggcccttcactagcagttgccctaccatatttatctctataacctcagctctttcggcatacagtaggtggtagaataaagttccttcattgaacaaattaacaatcgactggcatctcaaaaaacctacctgactctataggtagactatagcagggatatttcttggttttcttcccagtatctcattactgggttatccaacagtatgctaaattccaataggggaattcatttttctgccataccctactgtgcatttgaggtgagactgactggcagcccagggtgtctgatgggcttaggacaacctgcctattccatcatggccacagtgatgacttctgaaccgagcatgtaacccaaccagcacctttggcctgagaggatgttttctgagtttgcaaggaaaggatggcttattcctttgtagaatgaaataagaagcccctacctacccaacatgcacacaggacacgagggaggaatgctataagcctcagcagttggtactcttcctcagacctacagaagagcttttcagaaatgttgcccacaataaacaagcagagccaagaaaaactaggcagaaacccagtcgttgttataacatttaagtactggatcatattgcacctgaagtgggtacccctgggctgtttagttacatgaaccactgcattccccttatcaattaagtccatttgagttaacgtttctcttaaatgtaactataacagtcataacatatataaggttattggatggctaaaattacaatgagacatgaaggaaacgtgggcatatcaaaacaaaggatagaggagagaagcaagaaatggtaaattaatgctgcaaatactaatggtgaccatcaccaaaccatgggaactaagatttctaaacagtcttccagataccagatcattgttagcaaagcaatttcctatgtattttattagtttctttgaagtatataaagtttcttgcccagctcttggcacagagtagtcctcaaaacccaataattttcataatcccactttcacccaatccccctcggtcgtaacaatcaacaattcatcttaggataataaaataaccacttgaaagcatgagttattgtctttgactttagagaattcatggagtttaagaaggtgtcagatggaaaaatatagaaagttgactcgttccccagatgaatgcaaaagtgaaacaccaagtgattgtttttagaggaatatgaatcatcacagccctgggagataaagcacagtgcaaaaggaaatgtatccagatcttgccaatattgatattcagccagtaccagacactggggagacagtgatggaaagtcagacattatacctggcctttttgggtacctcatattccagtggagaaaccaaacaataaaactaaatagagtaatttaacttttaataagctgtgtgcctagggctaatttgggaaggtagtcatggaaggcctctcagcatcgaaggcttggcagttgagttataaattatgagaaagggccagccaggcagaggtctggagaagaagaacccaggcacatgtccagcaaatatgaggacttcaactatgaaaggaaagaaagagaggcacaaagtaccataggcatccaaagagggcagacatagccgtttacaacttgcaagggcctggaatgtggttatggtcagaatcctgcaaaggatcaaagctctgggcccccaaggaggggttatgtctgaggctgactaatgtctttaaacctgggccagcagtgaccacagaggaggctgaggccactgacatcggcatgacccaggccggcagatgctgacattcctttactatgtgattcccacagagctggggcttttcatcacgaatgagcattattagtaaccagactcaggggagggagggggacatgtatgcagggagtgagaggcaaagggaaagtgggagaaaaacagggctggacacatcatggtgccagggacccaaggtcaaggggcgagaccctcaggctcgatggcatttggggtgtgggacacttctggctgcagggccctcagctgcctagtttaagactatgggttgtgtttaggggttaccacctcagtctgggaatgtcactgttcccctgagactaatatttctcaagaagctactgtttcagtcactgaagccaacagggtctctacatggggtgaccataggatgtgccacctaaactgggacttttcagggtaatagggagtgggataaattctaaacccaatagaacattgagacaactggcatgaactgggccaactgggatggacggtggccttgctcatacctccctgctcttgcggaggcagtcattgactgacttattaatgtgtgttgggtgttaagaattgcgcacgctcatcttctcctttaagaggtaagcaaatagtagccctgaagagtcaagaatactcaggggctcagtacgaaagcaacatagtattccagttagagtgcaggtgcagatttggatactccttgcctccaatctcactgccactgtttactctgagcaggttgtgttgcctctctgagcctcagtttgcccatgtgcaaaatgggaatgataataataatacttaccttgccaagtattataagcttgaattgaaataatgatgtaaggaggttagcatggtgcctggtgcataataagcagccacaaatggcagttaataggattaattctcagggatggagaaccctctaaaaggttgcatcaggactttgctaaacaggcctctaacagaacctcattctccatcctctgggtgctcctcccagggcctggtgtatgcgtctcctttagaaggaacacacacacattcttctgcccagggcatgtctttccctactttccagaggaaaatgtcctgattcattttccctgtcaggaggctggaaggaacaagcaaaaagaaggagagaattgaggtcattggtccatccacacataagctccaattcagtctttccagggaatcactctggatttactcaccaccaagtgacagatgagagcaacttagtaatttgaaaacctgggaaaataacatgtattctgagatgttcccagtgctggtttggaattactgagcactgttcatttcagccttcagcagatcatgccatcctgagttggagttggcagttctagggaggtcctgagattaacccagagactgagactggactccagggagtcacagcccagttcaggccttagccagggtccagactgtgcttgctgggttttcagcttttccaaaacctgtataaccaatccctgccttgttgtctatcttcgattcttagcaaggttcctgtttcaagatgcaaccacagagtagaatcaatgtaaaaagacatctatacagggagcactgtgaaacacacagagggctacaatctattattgccaggtgctggaagatcaggaagagctaagtagaagaggcatgacatgcaaatagggcctaggaggatgaggatgagtagagagtttaagtaagagtggaaaggaaggacattgaaaacacaggaacacgatgcacacaggtaggaagacaaggtggtgttggcagatagatcatatatacatgggtaatgcctgggagcaggcttaggaaaaagcactgcctcaatttgttctcttattaattagtctagtgtctttcttagtcacagactgtgatatccagggtccaagatgacctctaatgatctcctcctcctggttttcttgtctttgtgtggtccttactcccacttaatagggctgaccatgagccaatacgatgttgtcaaaattaaggtgtgacttccaagtctagatcatacgatatgtttccactttgctctctcttggctcctagctgtgggtaaagacagctaccctatcattaggacactcaagcaaccctacggagaagactatgtggtgaggaactgaggcctcctgccaataaccagtaccaacttgccaggcatgagacaccttgggagtggattttgcagatcaggcatgtcttatatgaaggcacacctggccaatagcccatttgttgcttcaacagccaaaaccacccagctaagctgctcctggattcctgactcctggaaactacatgccagtaaattacctttactttaaactctaaatcagaatagactatgttgtgcctttttttcttggagcttccacacaaagggatcttcatcatggactgttttgccacaataaacagaagatctcctggggcatattaaagggaaatgtgtccttagataacctggaagctagatgtttgtcaatgtggcttcatgtggttgctttcctctgcacacattctgcattctcctctatgcagctcacttcctttgtacggctgtaagtttccatttacctagaacttgcatttgcctatggtttgtggtggcaaccctggctctaaccttacatgacgttattgatccagagtcaatctcaatcttaccacatgttttgtgagcttactttatattttcaagaacgaggatgattggctcctcttgagtcaagtacctgcccatgaactcttcaggtaggaccaaggagcagtcacccagtatacacatggctccttagcttccttctttaggaatggactggaagaatcatgaccaaatgaagggttatagatctggccagcacttcaaacattgccatgtgtagtacatgtagccccaactaagaacttcccagaaaacctgctgcaagatcaagatcaaacactctctccatttttatgaacacactagggtgtgaaactttctctcccgaataagaagaaacttgaaacaaaatcctgttggtagccaggcattaggattcatgactcaagacccacatttttacaaaagcaattccaaactctcaaaatcaattatgcatcatattatatcctcagaataaaataaatatacatcccagaattaatatgaaggcataaacaactgctgacagcctataaattgtattaggaaaactttgataaactcttacttttccacacttccctcaacctcatgacaataactgtttagattcaacacatatcaggggcatatgcagctggaagtaaggagagttggaaataaataaaaaggaaaacagcaagagcaggagaaatgagcagaaggttaatgactttaaaggggaaaaggtcacaagaagaagtgaatctgatagccctggaaaacaccctttttcctttctgataaaggaaggtagctaggagtgtctttatgaatttacttttcatgctttccctctggtccttagcaaagagggggaaattcagaatgagctattatttactcaagaaatagttactggacatctgaaggtgtcagaggcgttcgaaccagagcaactccatcttgagtgagggctaggaaaatgaggctgggacctgctgagttgcatttccagaaaggtattcctagcctctagatatttacacttaagggaacagattgataatgtttactaaacagatccagacttgggactctccgaatatcccgatatcttgagaacaaaggcattcctaattttgctttaaagataataatattggccagacgtggtggctcatgtctgtaatcccagcactttgggaggctgaggtgggtgggtcacttgaggtcgggagttcgagaccagcctggccagcatggtgaaaccccatctgtactaaaaatacaaaaaaaaaaaaaaaaaaaaaattagccagtgatggtggcacatgcctgtagtcccagctatctgggaggatgaggcaggagaatcagttgaacccaggaggcagaggttgcagtgagctaagatcatgccattgcactccagcctgagcaacacaacaaaactccatctcaaaataataataataatattgattcttgcaaaatatagtaattaagaaaaccaatcctttgtcacaaaccctgtagcagagcacgtctcccagtgatcttctcttatcctgtatataaacaagcattgtacctagggtggacatattcctcctcttactttcaggaacgtcctagtctgtctatggagtagctgttctttcatcactttactttctcaataaatgtgctttctctttgcactgcggacttgccctgaattctttcttgagtgagattcaagaaccctttcttggggtctggatcgggacccctttcctgtaacagagggactaaatggagtcatgatctcaggcaacttaaaaaaaaatacaggagacagttgaacaaacaattgaagaaaaataggttcattgctatatcatgggcattgtacaaaattaattatgtgtccaggaaggtggggggattgagctcctcactctgttgaatgggttcatggaaagggcagtattatgggttgaattgtatctctcccccaaaagtcctaactaaccctcagtacctcataatgtgaccttacttggaaatagggtcattgcagatgtaattagttaggttaggataaggttattagggccctaattcaataggactggtatgtttatacaaagggggaaatttgaacacagagacatgcacacagggagaatggcatgtgaaaatgaaggcagaatcagggtgatgcttccacaagccaaataaccctaaagatcatcagcaaaccaccagaagctaggggagaggcacgaagagattcttcctcaaccttcagaaggaaccaaccatgctgactaacaccttcattttgcatgtccagcctctagaaatatgaaaggataaatttctgttgtgtaagccacccagtttgtgacacttagctatggcagccctagcaaaagaatacaaacattttatagtttctaaagattaagagaagactaacctgctaaagattaaccttcaggctgagggggccagaatagggcttcagtcacttgaggagggtagactttgggaatatgagaaaatgcctcatgttgtaggagtgcacgttagagagggatgcaaagtgtggctgtagagaaagagaaagggaatgaattgcgaaggcacgtgttgggatgttgcaacatttttaaaggaaagctggggaaaagagaggtattgaggcatcggaatcacgtgagggctgctctgtgataagtctacagtatacctggtaataacagatatccaaaagctatttgttgaatgaatcaagaagaattggctacttcagtgcaaataatcaagccatgggacatccagcatcaggctctaccacatagcctattgcatgagtgttccaggtgtttcgtagtcccctggtgaaagaagagccccaaaggcaagacactcattttccctgaaatgaaaaggtcagccctagcaaaggggaggaagtgttccttgtacctctgtcttccccatgcttccctgcctttccacctaactcgctcatcgaatgtcgtttaggaaccatgggttgccaaatttctctttaacctgaattatatgtttggagacagaaagtgtaagatggactgagaagccaggagtagtaaccagtaggtggagagatagtgaccagcccctggaccccttcagaggacttgccccacctctgaactgctctttctgaaacatcttgctttctgcacaaatcatgttgtgggtcgtggtgggagccagaggggggcagccttgcagcaaaatgcctggaggctgcattaacttctttccctgacaacttatatggcagctaatttatatgctacctcctattagtttgggggaaaaatatagctaacgataacgaagagaatgccatctatttctttagcttaaacatgcctgcttcagtggtgaacagttgatctctaagcttgctgttttcaggctataaaagctgtttatttcactctataaaagaacatttgaacttatatagctatttaagtttaaatgttttaggggaaagaaaaatgcaaggggaattagcaaagagaggctgaaacctgatctgggctgcggggtttgcatagaaacttccctctttgggaatcccccctgcctgcccccagtacacccactgcagcaccagcccacaggaaatgtactgagctgagtgtgatttcaacattagtagtcatttcggcaaagctctcagagtcaatcatttctcatgcgctggtgtgatttgcattcactggggaccccttggctcttaaaaagctgcagctgccccaaagaggtgaaggacattaacaaatctttgttgtttttctcttaaaaactgtgagtttgcatgagggatctgggtagaaatgtgcttctctgtgcatcatgggaggctgctgctctgttggctctgagaatgacagataagtcttgagtttttgacaaataagctgctttctcttgaggagtgctcagacttccagttagccaccagaatgctggcctttatgtctttctggaagagttaaacattctccaaacaggctgaccatgcatcttagtttgcccaatacaatcccagttcatgcctgttgtgttcttggtgtatgttcaatggtgcttccttcacccttcagaatgtcctgcttcagatcataccttatatgacaaatctattcctggaagtcttttcttgcattttaggccacatttgcacccaatttggggagatacaagtgctttgggatacagatgagtttgagaggtgagttctcttggtttgggttcccataagatcagctctgagtcaattgtgtgcaagtagcgtatttgggaggtgcagaaaacacctgttggcaaacagggatataagaataaaaggacagcaactaaaataggtgccctggacatctggaacttaattctgctgaggacactctggcagacaaagaatgccatagaatcatttctcatggtgggtgaagataatcccaggggtgttatttccattacttcctgtctgcctgctagagggcaaagcagccttcagctgctttggagaaaagctacaactataggaaagaaggatgaaatggagaaagaaaacacaagtgttatcgagtatccaaatgtttcccaatctttctaggcttagcttaattgatacatatgctccttcagcagggtcatcttcataatgaaattattttaagtgcaattgtttaatgtatgtctcacctgccaaactatgatcttcatgagggcaggactgcataggttttcttcaatatgttctttgaacatagtatgataatatttgtcaaatgcatcaataaataaataaattgtgtcagttgtgtcatatactccatcactcaatgttttccattctatgacgtaacgattataatctccaatttgtaggcaagaaaacaagaagacttctcaatattatgttgttaggaaatacaaatctaggtctgtcttactaattccaccctcttccagtatagtcttctggtaaagaggagtattgataaataaagatgttcccacttttttttttttttttttgagacagggtcttgctctctcacctgggctagagtgcagtggagcaattatagctcactgaagccttgaactcctgggctcatgcagtcatcttgccttggtctcccaagcagctgggacgtgtagcatgccacagtgcctggctaatttaaaaaatgtttttgtagagatagggtcttgctatgttgcccaggctggccttgaactcctggcctcaagcaatcctcccacctcagcctcccaaagcacttggattacaggcatgagccactgcgcccagccaagaacttcccattcttgcaggcctctttgcatctcagcatgttgtgttctacaaccacacatgctgcctaatcctagtctgccacttcatatactcttggcccttctccaatttaccctcctattttagggtgtcagactcaagcctgctgtaattgtttaaagacttaacatggaaaaggataatgttttgtttgttttaatcttcaggcaagggagaaaaagccaaagtttcagaagctagtgcttgcctttcccacgaatgattctgctcctgaaaaaaaaggaaaggcacttaaggatttctgacatcatttttttcccttcttcattgtcaaaagtctggtcaaggtttgatggggggcggggtgaagtgaggtgggagagtcgagcgctgtgctggtaaatgttcaaaaaccagctcccctggaacaaactttcatttgtagcatatgccactttccatggtgtgaacttaaaattgaccactgtggccaattttaagctatcaatgttgaatcactgaatgtgaatgttgagaatggacccacagtactacaacattatatagcatttccatcacatggatataatagatgtaaacaacctcacaagcatggattgcagtacaataattgaaaatagtgaattttgagtatttacttattaccttttaaaatgcagtttattagcttaaagtttattaatgtaatttttattaacagctgcatctaacaactagaacacaaaatttctgtaagtttaatcgtcagctcacatgggctgctacagctacaccattttagagactctctcttgagtaagtcctttagtttgtagattctattcagatctttgtcctaacttcaaatgagtgagatctccaggtgaaattggccaatggaaagtggttcaagattatggctggacaactggagagtgaaccatcttttgatgctctcaaagtttgagacactttgtgtgtgagatattaggcttgccactaccctcctccctaatgaattattggccttttgtgaccctgtgtctctggaggctgactcctaaggagtgcactgctcaaggtcctttgaccttttgcttcttgctaagctcagaaaaaaaaaaaaaaaaaaaaagaggcactggcaagatacatgaaataagaaggagagagaattgggagtatatatacccctactctctccctgcctcactgcagttctgacattagctaaaaaggctcctcttaggtgggcatgttccatggctctcactagaccagtcccagttccctccccttggctttctctatagctgcttcctgggtgccccaccaactttcagtccacacctctgtaaacagtccctttattaaattctttccagctaaacagttttgagtgtgccttgtttgatagaagcaccctatatgatataccaagtgcatatatccagagtaatatatccaactgcattggtctttaggaaacctaataacctaattgctcatatggggagcacatttctacgttatattctattatgctcaccctgtcacgtccatactattatcaatgtccagttatcaatgatcagtgggaaaaggggacacagacaattagctttccaaatatagggctttcttaactcccacatgcaacttcatccacccagtgagcacaccatcaactcaccttgactggttggctgaaagtggctcatgctttgctttgagaaccaggatttggctctaatattaggcacagcctgtcctgtgggacttgtaatgaaaccaggcagctgctagggctctctcttatagtccctatcttgttcatctggcacaacagctatttctgaattctgcattttgtattcttcttatggacacctttctctggcctgacattcttcttggtctattgtcccagacccacgcacgaattcagttgtcaaaacatctaggagccaatgctaggtcattaaactaacataaattgagaccatgcaccagttacacactcaactcatattagcacagtgctaagaagttcacacatacagcctcttctaccatggtaaaaacccaacgagatgggtaccatttatcccacttctccaacctattacctactgcttgtgctggtcatttgtctgcactcggatatattccttacccttctttccatcttctctgtattataggaaactacatttacaggctcccttgaccactagtttctggctagatatggcctactgaaggacttggcaagacacaggacaggaaaaggccagggtaattttcttcctctcccacctggggcagcatctctggaagcaactgtgcttctcttgcagctcccactctcactggacagcgtatgccttgatggcctagcaggcctaccacagtcccagtttccacagggctcttgggatcctgcaaaactgctttcttcttttgtccctccagccctagataaggcactcactttctacagttgctaatttcttgcttcatctcctcttcactgttttagttcttcttataccttaaaactaattccctacattaaattttctctattgaagtactttgcacgtgttttgctttcctggctgcacttgactggtgagtttctctatcccttgtcttctataatcatatttctatagctctgtgtgtatgtgggtgtgtgtttaatttattgaaagcatcctgtactataactatttgttccctttatagtattaactagaaatttctatctataactacttacattaataacagtttatgcccttttacctgtttattgtctgccttccctgatagcctgtaagctctatgaagtcaagcatttcacatattttattcattgatgtatttgcaacactcaatagatgactgacttgtgggtaatcatattaaataaatgagtgaaaacattaatgaatccccattttacatataaacacactcaagcctaaagaggtgaaataatgtttagatcatctgattttgtgctgccaggtagctcagtgaactgcctcctttatgccacctgctttttttctatggatttagaattgtggcccagatttcctatggtagcagccatcttatttcaccttggatctcccaatcccattgtccctgtttctccagcaccactgtgtacctgctctaaacatagcctgctgttgtgtcatccctgtcatactaggctgtttatgcttccttccatggcaccatgagccatattttccaatatttctcccagtcctggggtggtccacatttcattccagcctggatccctgactttcataagagtacttatgaaactgcatgccaacatttcctaacaacgtataacatctggtggaactgaggaactcaggcccacacctaaaatagggggtttccccaaataacctagcctgagctgagtctggcctgagctccctgctagtgttgccagagaaaatataaaatacccaattgaatttgaatttcagaaaacaatatatatatatatatatactggtactgaaaaagtatttgttgttcatctgaaattcaaatccaactggacaccctgtatttttgattgctacatctggcaaccctactgtctacagttgtcaaatagtgggagagctgaaacattaactaagactatgttcctttccaagagaacttttgaaaattatcagaatctcccaaagagatgtaaaaaaacagatccccaagtccaatcccagacctgtttgttggataagacctcggatctgcttctttaaaagcgtctcttgcattctgtgagtcaagcaggctttatgacaactctgattgttgccataacagaagcaatgagagaaatcagtggatgcagatataagtgaaaacaaaacagaacaagagttttaggtgacaccagaaatcaggctatctgattctcaaatattgtgctcctctgaagcagaagggagggactgcctgtgcccagaactgttgaccgatcgtgtcctggagactacttcctgtccttgttctccatccttgcctcctcagcactctggatggcggaggtcccgacagtaaccaggcaactctagagtctggcctgagctgcctgctagggttgccagagaaaatataaaatacccgaatcaatttgaatttcagataaacaatatctatgtatatgctggtactgaaaaagtatttgttgtttatctgaaattcaaatccaactggacaccctgtattttttattgctatatctggcaaacctatctacagttgtcaaatactgggaaggctgaagcgttaactaaaactatgttcctttccaagaggacttttttcttttgtaaaataattttcaaattttattttagattcaggggatacatgtgcaggtttgttgtgtgggtatattgtgtgatgctgaggtttgaggtacgaatcatcccattacccagatagtgagcacagtatgcaataggcaggtttttagcccttgtcctcctccctctcttcttctctagtggaccccagtgcctattgtttctatttttatgtccatatgtgcccaatacttagctcccacttagaagtgagaatgtccgctgcttgtttttcttttcctgtgttaattcgattggaatgttggtctccagctgcatgtgctgctgtaaaaggcatgattttattcttttttatggctgcatagtattccatggcatatatatataatatacatataatatatatataatatatatacctataatatatataatatataatatatatatacctataatatatataatatatatattataggtatatatatatatatatatatatatatatggcattttctttatccatcaaggtacccttgatgggcacgtagggcacgtaggttaattccatgtctttgctattgtgaatagtgttgctatgaacatgggagtgtatttgtgttttgttttttttttttttttttttgtagaactatttattttcctttggttgtatacccagtcataggattgctgggttgaatggtagttctgttttaagttctctgagaaatctccaaattgctttctacagtggctgaacttttctatttctaccaatagtgtataagcattcactttttctgtagccttaccagcaactgttattgttttactttttagcaatagccattctgactgctgtgaaatcatatctcgttttggttttgatttgcatttctctgatgattagtgatgtaaagcattttttatgtttattggccatttttatgtcttcttttgataaatatctgtttatgttctttgcccatttttacattttgttgttgttgtttgttttttgagttgttttaagttacttatagattctggatattagacctttgtcagatgtgtagtttctgaacatattctcccattctatgggttgtttgtttactctgttgatagtttcttttgctgtgcagaagatttttagtttaattaggtcccattggtcaatttttatttttgttgcactttcttttggggacttagtcataaactctttgataacgctgatgtaagaggacattttgaacttctgtttcttcgagtcgcataaagccagtgatgttgaggaagtccctctttaataaacattgtcttctacaagacttattctttgacagattcaattctgcacacatgtagtatttagtacctatttctgtctgccgtatgggttccaagtctatccccaacatgatagtggcaaatgctcagtgttctaggatgactttggcaagaagttccatctaattagaagaccagcatcaatatagctaaaccagctcaattgttttaggtatataatttgtcttccaattttgattactgcaaatatgtttaccaaatttgtttaagggcatatcctgccttattttgcatttctcatagatacatgttaaacatggaatttaatacataaaaatggtaggatatgccctttccatgagtgatgggattgtttagtattcttggggaagtctctgtgtttgtcctttatttattcatttaatatatcttttttgagagtatattatgtgctacgtggtgttctaggtgttgggaataatgaagtgaaacaaaacaaaacacagccttaaggagtttgtgctatggataaaatgagaaagaagcgggcaggatgggcctctggggaggtaatgtggctgcaattttaaaatattcgttaagaaagacctcactgaagaggtgacatttaagcagcaatttgaaggagaactgcttttaggattttaagaactctttagtgaatttgtttaatcgtcgctcattttaaagtgtatacatttacctaaaatggagtactcatagcaagtctatcatttatcaggacatcaaatttgtaaggtgatattggaatgcaatgtgcttaatgtaaatatccactcttcaatctcaaatggaccaactcagaaaaacacagtgcattacagttgtttctaattaatatttgttcatgcagtatagtgcttaaagtgtaggttctgcagtgcaactgcttggtttcaaattctgtccccaccacttagtaataatattgtgtatgacagattgttataaatttctgtacctcagtttcctaatgttacattgggataactgtattagttacctcagagtgttattgtgaagattgaaccagacaatgtacaattcctatcccagagaaagttcttcatggtatgctaataagctggctctccagaagaaaaacaaaaagccctgatatagagtttgccaatgttcatggcataaaagtctcaccttagtcaatttcaagctcagtacattgtcactgaacatagagttgggaagacatgcacacagtcagctacaatgagctataacactgtactgactatataacacactaaatacatgattcatggtgccatattatcaaagataagtatttatttgtaggaaaataatggtcttaagaatgtatctttatgtacatatattgatggctttagagcagactttctcaaccttggcactgttgacaatttgggtttgatttttttttaaattgagaagctgtcttgtgcattatagaatgtttaacagattccctgacttctattcattagatgccaggaactaccctcctgccctagttgtgacaaccaaacatgtctccagacattgccagatgtcacctgagggcagggaggaattccctggttgagaaccactgctttatagaaatggtagccagaaaagctagaaaaacatgtttctagaggaatagatttaaaatcacattttaaaagaaagtaacaacaatacaagtgattacaaatacactgaaaagcgtatcagtttttcagtaattgatatttttaagaagatgagcaatgggttaacactaggtggaaaggtgggctaagatgtcacaggtggcaagcatcatggcagagtggctggagcctgttggtgtcagataggcctcggctcttacctggactctgctccttatttgctgtgtgattctgggcaagtcacttaaccactcagagcctcaggatcctcattaatggaaaaagaatgaagactgactgaaacagattgcaaacataataatcaagtcttataagtatttattgaagaggaaagaaaagggtccttgttagctctgtgttttgggggactggtaggccttgggcaaggactgatggcaggggaagcccaaaaggtgtggtggactggaaagcacaaaatgataaagtgcctgccccgtcacacacggctgcgggtcactgcttggaaatgtgagaacaaaatgggaccccaagctaatgactttcaggtgtgctggcccggctgcctggtcattggggaatgacatagaggccaaggctaatgctccggggctgccaaggcaaacatccagacccagggcaaatcaaccagagccagggacttggggcctctcatcgcactgcacagcaccctgtggctgcctgggcctgcacctgcccactgcagacacagcaggcactgcacccttgcctctctcactgcaggcctgccgtccttgctcccagatgtccccattgccctgctacctgcccaacccagcactggcactactgttctctctttttcaatcccaaccttgtgaaactccagtgaaaattctgctgattggaacgatgcctgagtcagtgcactttagctatgtggacagagaattccttctttcttcctgcctaccctttgtttgctctattctttgaactttgcacagtgctccactccaggcatcactagtgtttcttggtgtccccttcttccttccatcacccagctacggagatggacccaacctatgatgcatttcatacaagctcttttctgctcacacaacactctctgatgagccatgggacagactgaatgtcacatttgtagcatcagttactccaaaggacatgatggaaggtagccaggtgggtaagcatgcaagtggacagcatcagctgggttcagggatgcttactgataccacacaaattctaccttgcaggcccctgaccctaggcttgcagaaggattcgctctgacttcacaaacaagactgttgtgaaagtatttttgttctgggacttaccgtcatgggtcagaatctagatgctgctgcttatttaatagctatgcaaacattattaaactctctatgtctcagttttccaaactgtcaaactcttttttatgactgttgggaagataactgagactattctttcacttaacaagtatttactaagcattgatgatggtctggaagcagtgctagaccctggaccttagggatacagatatgaatacagcatagtctctggtctccaggagccacagtctaggagtaaaggcagatgaaaaactatagcaagatgaaacattatgtgtgtgtatagtacacataactgataagagtcaagtcttcctggaatacaccattcataatccttcagggccttggcacttattgttgcctctgccctcaaacttgcctcccagatatctgccaagtttgctccctaactttcttcaggtctttgctcaaatggcattttgtcataggcatcttccctttccaccttatgtaaaataacatccactctcttggggtctattcccatatctgttttcttcctagccatatcatcacctgatatactgtctttctttttccttcccttccctgctctagaatgtgaactccatgtgggcaggagcgttgttttattcactgctgtaactcaagcaactgcaactatgtttgtaatgtaattaaatgttacaataaatatttgctgactgactgaacaaataaacagaaaaatgagtgaaaattggaatgacagaataaaagacataattcttactgggagagtctcaaagaaaaaaacccttgagagggacctgcagatgtcagagttacttgaataatacagggaacagatgagggaagagaatgtgcaaaggacatttagaaagtcatggtctgttctagaagcagctgttatttgttagtaactagagagatgaagataggctcagaggcatggcaggaaatgcatgtggagagtgagatggcaacaaatctcatttaatcccttctaagaagagtgtacttggcatgcaacctagaacttaattttatttttaaaaactaacacagcaacaggcacatagaagatgcccaatgcttttcgagcgtatgctttccatatatcagtctgtgagaagtgcatagaaatctctaaggtggactattctactgaccccagctagcctcctatcccctgaacacagataagggctttatggcaggtaagacctggggtaattggtgtttggagggcaccacaccacaggctgtgtaggtcagcattagtatacaacttatggaaatgtttgccccttctcagaatccaggcaaggccagcctaccccagtccaaccattcatcccaattttaaactctccatttcaaaagtgctgttccataaagtgttgataaattagggcttaattatcccagctccagttccactatgctctggttacagtaaataaaccagtgcctgtttaagtagatttttataatggggcaaactcttgtgtagactttttactgaaacagaatcactgctttgaagagagcccaagtttcatagaagaggcttgtggcaacttctccctggctctgcagatgtgcttggagaaaaaaggaagctgaatactcaggctggactaaaatgagggaggccacaaaggaactctgtgaagtcagcagtattgattcttactctagtttctcacacatgtctaaagttttaaagagatcatagtctaagaggaattgaagagccatattgtttttgaaatgcatttttaaattttttaatgatagttgagaagtaaatgaatgcaattgctgtggtgtggaagcatggtgtgaggtaggggtgtgtgtgtgtgtgtgtgtgtaaattgaataattataaactttggtgaatgaccttttaggttatctcaattgtaggtggcattacaatttactcataattttaaggcctcattacatctcacccagagcaatggcctcttaattaatttttttgcctccaagttcacccaggtacaatgcactcttcatatcaccatcagccaaatatttccaatatacaaattgaataatgtcacactcttgtgcaaaacccctttaatataagccactgtcctacagaataatgtccaaactccttgacctggaatttagaggtcccttccaagtagtatctggctatcttgccatttgctatgtttcaaatgatggaaatcaccagggccctgctatattactgtcttcctgcttgtcaataaaaaattactaagcaccatcagtaaatatttctttattgaaaaaataaagataatttgaaggaggtacacaaatacaaacatctatttatgttctctcccttttatccctttcttttttatggctccaacatttttacaaatacataacttctatgatgggacccatgtgctcataaattaagattagaatgagaagcattgaaagggtgaataagccaagtctaccttttatttaaggggcaagcatttgcagagacattggtcaatgcattgtaaagaaatgactatgtcctccttagaaaattctgaaatggctaatcaagagacccaggctggatgagtgatgggaccttgcctcactcagctgaggagaaaggaaggactcctggtgctctcatccccacagatctcccctggcaccatcatgaccctggttacaccaacctccatgtgccacctccatcagaaaaaaggttttagtagcagcctactcttgacaatgactgatgaccagcatgctttgggttccattgaaaagccagcttatgtgacaggcatcactgtacttactgcaaaggaaaattatgccatttcagagaaccaggaggaacacagcgattgtacattgtccagtgattttcctatctaagaggcaaaataaattttctatctggaataaatattttggaaaatagctggtccgtgttttaattggcctggatcctagtagtctgagatgcactgaggccatttgattcactaaaatgttgaaataattgagattcctcaataattttgaggggtaataaaagcaagagataccttcaaatcaaccctagatgagagctgagacctgttcccctcttgttccaatctaagggctggacatacctcaaaatctgaggatgggaggattacctacaatgggttgagattctgggaagaggactagaattctatgtaatcactgggctgggccattcatttgggagccagaaacaagaaaatccagctgtgggagtgtagataaaatcaggatttggattcaggtcttcttcatttcacatcagcatgtatgtacgttgtaccctggtcccttccttaattccacgttgctagtgtttactgcatgtggccatatcaaaaggactcattcatgttctgtgtctggcacaccatacccaatcatgactctggaggttgtgtctctctgcctttggttgattttaatatgacatgaggtcctggaagtccctcttattcattttatttatttattttaatggcctaaattcaactccactaagcaaatcaattcagcactgaggctgaaatttacaatacggccaccaatactatggctcaacaggatgcattaagaggctagttaaacaccaaatgcagtataaatctcagccttataggtgtgctgaaaacataaatagcttccaaagagccatgatcaataccaagatatatgtgcaggctccaagtgtgcaaataatttaaattttaaattagcccctccttagtattcccaaatatcctagactttgcaatttctgttaatgatgccaaatttccagtatctaatcattggtttttgagtttctattaaaatatccaaactgggactggggtggcatcatgcactgtgtgtttattggaatccagagatgggaaatgagaaagacataaagaagcgagttacagagaataagacaaagggtgggcatccaggaaggtacaaataggtggcacaggagaaagggcaggtagcaagttggtattaagaaagtctggaagcaggtagaaggtgccaggtcatatgaaaaatgtgttttggcaataccttaatggtgctgggttggccttgttatggaaaaccatggattctgagcaaggaaacaaagtgagaatctcaccatgtgaacaccagacatagctgcaagaaagaaacggcatcagaaatgatgcagacccaataccactgccaagtcataaagaaatcgtttgcctgatgctggtgttggctttgaggctgaggctggctgagcctgcaggagtgagccatgggtactcagaaggctgcaggcatggggttaagtggggaagcgacattctctcctctttagtccctacacctctgccttctctggaagcattatcctaattttccccaaatcattcactctgggcagaggccagattgcaaatacctgggcatgaaactatcctttacctgggtaatttcaggggtaggagatcttaatttactttcattttcttctagatcacctcacctagtgggccagagagttgggcgacctggtttccaatccccactctgctgctcactagcagtgctaccctgggcaagttactcgacctccaaaaacttccatttcctcattcataaaataggagtaacaattaaacctacatcattgagttaatggaaggattaaattaccgaaaggcatttatcctggcccataacaatttctacactcactcttatattcagcaaatatttattgggcacaccataggaaacagacacatttttaacactgagaatacagtagagaagagtaacaagtccctgctttcataaaacttttattctagttgaggaagaaaataataagcaaagacaaaagatgtgatatgtcaggtgataaaggttatgaggaaaaaataaaataggctaaagcaatagagagtaatgggagtgctctttcagctaaagcagctaaagcctttatggaggaggagatgtttgagcagagatgtgagtaagtgtgggagtaagctatgcacacttgtgcaggaagaggcttccaggcagaggaaacagatgtgcaaaggtcctgaggcagatatgtgctttcagtatgcaaagatgaagcagcaagaagactggaggggctgaaacataggcagagaggagggagtggtacctgctgagcgagagcaggtgtcctaggcagccatgataaggactttggatgttattctgaaggagatggatgagaaatcatccgaggagtctgaaaagagcagctccacgacctgacttacagtttgtaggagtagccctggccactgtgtaggtaaaaatggggcctctaaggagctcaccgtagttatccaggggaaagatgatgaggatagtaacaaccctgcctcatatgaatgtcactgggacaagttaaggtcacaggagatggtgtcgtcctatgtccatcataggaactctcttattatttctctgtctctccttttgcccctgtacatatgcaggattcctgccccagccttcccagtccttgtataagaagcactctgctgctgtccacctgcagagccagtgctctgacatcagggaatcagttcagccttaggaactggtccctgtgtgctggtgctaattactggagatgtggattccaaaatgcagtgtatcctgaaagtcttgggcccaaatgcaaaagcttctccttatctatggagcacctttctgcccattctccttattgcccctggcctattcacttggtggtcagactgaccttacttgtggcctgaaattccagagagaaggcagcagggagaggctatttttgatgtttattaattctcaaaatgctgggttttgagaccccactacccctacctcaaaggtgatgccacggacaaatcaaattaacaaacaaaggaaaaggtagagacgggtgtgttctaaagacaatattctctgagaagatgataggcaggctctagactcatcctttaggctgcctccctgacctctctggtacccatacttttggtcataagctgtctccatcttcacaggtttgctgcaacagaaaggggctcatgtcaacttcctcaacacctcctgagactgttaaacagctggcaggaatatgagaacaggtccattctcatgaggttcactagatttacttgtttgttgctctaagaagccatcactcaaatttctgcaatgcaactagttaacgtgtccttccatacagctttctgaatatcccccagcctttctccctctgctcccaatgccctggtgaagatgtggccttattatctctggaataggttaaggtaccagcctcctgaatgttccacctgccatcactcttgccccctttccaatccaaacctgagcaagtgctcttcccacttctccccactttttttttttttaattttccaagggccttggaagaaagtgcagctgtgtgacttgtcttgcatgtcaccactctactgtgagacattctgcagtcccactagaatcttcagctccctggagaacgctgcccccatgtacacttccatacctttacacatgccctctctcctgtcatttttatgacctagcatccaattcaaaagtcattctttccataaagttttatatcagtatcccagaaagtgagattgctcactcctccaggtaccccattcatttttttaccttcatttcagatatcccaaattattttctaattatctctgtgtgtggcattctccttcactggtgcatcaattctttgagggcagtgactctttcatgctgccatgcactaagcatttggtattgttgatttcatcctaagtagatctagaaagatctgaggagaagagggtataacgacacagtgagtcacacctgcagtagggaaagaaaatcccaaagcacatgataataatgtttgcaagtttttccttaatctttcatgtatgtaaagtgtgtcgcagatatggactcacttgcccttcacataagtcccatggggaaggcatttttattcctgttttgcagatgccaaactgagtcttacgtagaggggctaactgaattgcccagtgtctcacaagtcaagtgtggtgtgggagccagaattcaaagttcactccatcccacttcaacacatgagttcttagtcactatagaaatgtgccctctcgcactgggagatgttgacctgttggcctatgtatgatgagctctgaggttgggcttgcaatgacttgaggaattatgtcgaagcgactgcagcagaggctacaaagtgtctgcctctgatagggtttgcagacttgcttctctgggttgtcaaccatttaaagcacaaaatgaggaagacttacatggcttggcccagtactttgtctataatcccaaattatacttagcaacctcaccatccaagccagagtcctttctttagagttttcaggcacaaaaggaatcatgattaatcagtaatcattatcaacgcttaattttgccctggtcctgatttgggggcaattatttgtggttgaaagtagtaagcagaggcaaagtgagcaaagataaagtcaccaaggttctttgagcagtttatggacttctttttctcaggaagcccttcaagaaaagcattctatagtccactcagaacttcttttgaccctcacgtatgtattcaaaaaacactcattgataccaaatcctgttatagacactatagctatggtgacaagcaagataaattatgaaatgcttattatacagggagagacaaaaatataacccagtaaaaattatgaaatataaaataattttgcattgcaatacgtattatcaaaaatatttaataggaggtagggagagaaaataatgaggattgcttgactttctatagtgcattcaagggagtcttcttggaggaagggtcatttaaatggaagcctgaagatagaacagaagtcgggtatttgaggattgcgggaaagagggctcaagatatggggagccagaaacagggatggaggctgcggaattaaggagcttgtgtacgtctggagtgcacaagatgaggatggtagtaacactgtctccaaaatttaattttgaatactatggttatgcatcctgagtgatccaggaaaattgccttctttctcttctcctcaatctctaagtacctaaactaagcctcctcctcttgcaacgttttatctctggtgttcatgggagttgagaacacaccattggagaatttcctcagttcaaagacaccagatcaacaaaacaatctggatgttaaccctgaagccagcctacaataatcagggcttctggctcaggttcacaatgagcaggagacctctgccacctccagtgctacctctttgtaaaacctcaacaagctattttatgtgaaaatattaatcactgctcattgcagcgttcaaaatcagtcaaggaagcctctttgaaggtggtgacgtaggggtttatataagggatcagctgatggaaaggagaaagatgcgcgttccagagagaagaaacaagctgggtagttttgcaaatggtttatgcccatgtggagacacgccaggttagagcaggtctgtgtgggagagaagttgtggttaggggcatggaattggacagagaccaaaaacatgggtcctagaaagtcaaattggaggactttcatcctgcaactccaccctttcctctctttttttcttcgaaattaaccggacttatttcttattctcctcatgggagatttcacagctattatttccattttctcaatagctttgggaggtataattatccccatttactagctaaggaaactaaggcttaggagggttcactgacaggagcgggagcagcttgggctcatgtcacgtgtcttcatagtcagcacatagcttcatctgtcctatcctgcacctgctgtgtcttactgcatttagattgcagccagctttctctctgtctctttgaatttcagcacaggtaggtactgcacttacccattcttatagatggcaaaccgaggctcagagatgttaaaccactcctccaatgtcacattgctaggaagtcgccaacacattactaaacctggggacatctgctcttcagggcagcactccgttgcctcccaatacccagtagctgtgattgttagatgatgatgatgattattaatagagttattgcttttggggcaacactagcagtgcagcagcgagcaggctagcagggcccagggcagcttgctcggccacatctgccctggagctgctgtctgctgtgcaccaggaacccgccgaagcctgagagctgtcagcacagattccaccagggagccagcaacgcccctcacttcctcaggcctctctgaaatccagccaaggaacaggcgctgagctcacagtcagatagctcccggagcctccggccctgggcacggtgccctagctggtggagatggaaacagcaaggcccttctgactcaaagactcctcattgcccctgacacctcagacttaaaacccaccatcactgtcattcagcatccaccctgccaggcatgatgcagggagagaggaggggataaaaaagggaagggccgtacagagccagggcagagggaggaaccgagctggagaaagcattaaggacccacttgtgaaaatcctttggagtgctgaggctaaaagcccatctgggtgggatcaaaggggagcccccaacacagcccatgactggaggatcagcaacttgcaggcctagttaggccttgatttccctttttctcagcttttgaggagaactacagtcactgcctgagaaaatgcagcctcaggacacaggattctaattcagtgcctgcacagccttccaaccagaggcctgcaaatggtagagtcgtccatctggatcattctgcaaattgtgaggtcaaattgcattaataaaaaaaagcattccccttttaattctctttctctttcagtttctcatcagattgggatgagatgcagaaatgcatcagattgggaaacacacctaatcctttgctaagctcccttttaaacaacaagcccaatctctggtaggcaagggtgtcttggtaaaacctaaatagaattgcctagtttccattatactcattttgacagtgaatcctttagaataggaagtatttcttgtctaaagtttctgtttagatcctatacatgaagtttttaaaagcaaaaggaaatcacagctcagccctttgcagatactctgaacatcttgaggagaggcagggacaaccggaggtagggaaacggggtctcggatgacaagcctcagctctgggaaagttctggaggtggcaggacagccaggccagagttgtccggtggagacttggctcctgaagccagcggggcacccctgagcagcaggcctttctcagagcaaacatcagtctctctcctctttgtccttaatgaccacagctgggtaggggggagaggctttaactcccaaggaggctgtttgtatccagcctgcgaggagaggcctaaattggcattccacatcataataaaaaaattcccagcaattattaaaagattcttatctcttgctccctacatggataatgagttccttctctgctggactgagacaggctgtctctgctctcacttaatgaaacaggaccaagtttgcaaatgagcttgccccgtctctccccttaacctctgcttgtggagttgtacatcaaaccttctggcttctgtctttccttattaacagcccgtaatcttagcagggcccttgccttggcacttcctctttgcatgtacaggtctggttttcactggacctaatgactgggggtttgcctttgtctttctgggactgaagttttaggggatccaggtgcttctggtttcatcaaataagaaggctaatgaacaatgagagaggggaagaaagagagggaatgtgtgtgtgatttagctgaaaaaaaaaacaccaaaaaaacaaaaaaacactactgctttctctttgggagacattggtgctggaacctgtatttagcaatggttctgtttgaaatcctctacccgcagctctgagttccagggattcatttctttccccaaatccagcctactttgcggggtaggatcaggtcagctgagtcatcttaacaaaagtcactgcattttacttttctaagtcacccctcttggccttccagggactttcctttattttgacaccatttcagcaaaaaccattgaacagggataactcttttccgtggagtatttgactgctttcctcaaagtctcctctactcctagggaaggaaggagactgtgaacatgagttggagcaggcagttttatggaataggttgatccgtcaggccttttgtgtgtgtaggctatctgtctcatagcatgggaactgatggactctgctcccaggacatactggtgctgttatctggtgaagtgcagctgatactttagctctgagatgaattttacttgggatacgaccagccaacgtttcaggagagcttcacttactctttcaggtgctgttctagttgtctgttgctgtgtaataaagtgctccagaacctagccatcttattgaacaaccatctattgtacctcatgattttgtgagttaggaattcaaacagggttcagttgggctgttcttctgctccttatggcactggctggggtctctaggttttattcagctggtgactggctttgtctaaagctccaagatggctttggtcatgtgcctgacaccttggggaggatgggttctctttgaatgctgtacttaactgggttgctttacatctttatattctcagggcctctccagtgatcttccaacagctattagactttgttttcttttgagataggttctcactctgtcactcaggcagtggtttggttgggtgaggggtaggatggaagtagcatgatcatagctcactgcagtcttgaacctctaggtcaaggtgttggacttcttaaatgattgttcaggtatccaagagtgtatatttccagaaataggaagtgacagctgctggtctcttgcagcttgggcctcgaacctagagtacatcacttctgctgcatcctgttggttacagccaccatcaaacctgcccagacttcaggagaaggaacatacattaggagtaagaacttggttggttctcagtctaatgcctacgaaaaaaggtaccagcaacacagaagttccttgaaggatgctaaaacttttctcttgataaccatgactgaagattaatgctttagggataggcagggatgctgaatgaggccagcttgccagtctctatatgacctcaagtttagaaagtgacagtgacagaagcataattttggatacccatacatgttaagggaaactaagatccacaagccgatgaagatgtggtctgggcttcatctttgctgcctgccagagtagctcagggcaaaaaccttaaaatgatgccagcctcttttgccaattgccccccatagatggtcccttgcagcctgggaaacagggaaaccaagagtcacggatgtcatttacaccagaagagtcaagcccttggaagagcagctgccttccttcctttgctataccaggagctcctgggagttacaggaagctccagttaccactgcctccatcagacgggatccttcttcaggaatgcaagctttgacattgcatctccagtggcagtctcttctgtactcccagcacttagcatgtaggccctggaggaatccagaagcagtggctccttccttcctaccaaggcaggaatgttaagtcacctcttcatgactatacctctgccccccattattgttatctctctttccagtcacaagcactcctgagaaataaacttcagatacgatgtgcactgactctccttccatgtttttttccagctcagcacctgaagtgcccattccatttaattattctctgagacactgaagatgggaggaggctatctttagtggatcccaaatctagctttgcataacaaataacctgtgaaacttaagattaaaaaatacaggttcccggaatctccttaaagagatcctgattcaagaggatgtcagggattcgtatgtccccaactcctccctggtcattttgatgtgagccaggcttaggaaccactggcctgtgtattttattaactctgagggatgcagggcccgcatttcaaaggatggggccaattagccctcccagttggtaagaccagcttgattattgaggaggcaaaggcctggggtgtgttttctatagttaggacctgacccatgacctcagccagctgccttgcaaatgccagtggtcaccagggcaacccagccagagagggttaatgattcagagcaaatgcatcttcacaattagtgtgggaggagagggaaaagaaactctctaactaagaacaggccatgctgaatctgtcacctctgaacaccatcatcttttattctgaaaatatgtagtagacactgatgcctcctttgcactttggatgaagtttaacactgtctgccatctcaacaatgttacctactcacatccctttcttccaaagacatctttattaaaacaaagatgaaataacgcacccatgtaaaacagtggttaagacataagttctgaatttaaaggcctggaatgaaatcttggctctgttatttgtgagtggtgtgtgtacaagcaagttaataaacctttctatgcctcaattttctcattctgcaaaattctgataaaattggtaactttttcttaggataaaagataaggtagtacttgtaaagtacttagcacagtgtcttctgtatggtaagcactcaagaacttatcaccgcttttattttattttattttgataaggacatttaacataaggtctgctcttttagtagatttttaagtgtgcaatacagtattgttatctataagcacaatgctatacagtagacctctggaaattattcatcttgcataagtgaaattttattcctgttgataaacaactccatattttcgttcctaaagcccttggtaattctacagtctgattctacgggttagactatcttagagacttcatattaagtggaattatgtagtatttttcatttggtgactggcttatttcacttatcataatggtcttgaggttcattcatgtttttccatttcttctttttaaatatcaaataggccgagcgtggtggctcgtgcctgtaatcccagcactttgggaagctgaggcgggcaaatcacctgaggtcaggagttctagaccagcccggccaacatggtgaaaccccgtctctaccaaaaatgcaaaaattagcccactggtggcgggcacctataatcacagttgctcaggaggctgaggcaggagaatcgcttgaactcaggaggcagaggttgtggtgagccgagatcgtgccactgcactccagcctgggcgacgagagctaaaatttgtctgaaaaaaaatcaaataatattccattgtatgtacctaccacattaaaaaaaatccattcacctatagatggacatttaggttgtttccttatgttggctactgtgaatcatgctggaatgatcttattgagatcatgatttcaacactttgggatacatactcagaagtggaattgttggattatgtaattgttctatttttatttttttgtggaaacttcaactgttccatagccattggacaattttgtattcccatcaacagtgcacaaggattccaatttccctacgtccttaccaatacttattatctttggttttcttgataatagtcatcctaacaggtgtgatgtaatagctcattgtggttttgatttgcattttcctgtgtagttgaacatcttttcatatgcttgttgcccacttgtctgtctttttcggggaaattgtaaacgttctagaagaagacatacggaaaaagcttcatgacattgatcttggcaatgcttttaaggttattataccaaaaccacaggcaacaaaggcaaaacaaacaagtgggatcaccttaatctaaaaagctctgtacaacaaaagaaacaactaatagagtgaaaaggtaacctacagaatgggagaaaatatttgcaacctatatatctgataaggagtaatttaagcaacaacaacaacaacaaacccacctccaattggccaaagtatattgggggcatctgtgatgccttcttcctttcttgtctctcttctctccagctcacacccaccattcaaatactctctgatccagcctattcttcttaccatccacaaaaatgactgtccagactttgccttcaccacctctgacttcatgacaaacattgctcccagcttgtctccctatcaacaatttctcctcctgtgattattctccaacttggtccagtgagacccttttaagatatgagtcacgatgactcattctgcgtaaagaacttactgatttccaatttaccgagtttaaatcttttgcttggtgcacaaagcccttcataacttgccccaaacttgccctctagcccactccaatttacttttctgtgtatggtatataccaatcagaattcagaaccaaaccagaatttaccaatccagtcagaacagctgcatagatgtccccatctgtggtttcctctgtaatttttttctttcggccaagatatcgattaccttcttttctttatggtaagcctcaagtcatccttaaagacccagtcacaatgtcaacagtccttctttgatgtccttaggtggagtcagtctcctctgtgttcccatatctttttctcccccatctctatttaagagtttatctcaaagatatagggtaagtatctgatgtttaggctaatgtcatgatgaagaggtcgggctctaaggtcacatagtcttaacctagctatgcctcaatttcctcctctaaaaaatggagatgattaagtggctgctatccacagttattgtgagaattaaatgaaatcatgcaagaagaatatgtagcagagcataccagtgttaaattaataccagctatttttgtttgcttttctctctgtaggttactctttcatgtgagtttctgaaggcagagcccttgtcttttgcatctgtgcatgctgatctcccaagaccaggcctagcacttactagctgcatgatgatgttggaaaaaagaaaaaaaaagcaaataagtgaattccaatcctgagttaattgttaataaatataccacctgactatcctactacatgaaatgtgggaggagttctaacctcaaatatgaaggccctgccttcctctcccttatttttcatttctactctttatttcttcttccttcctccctcccttccctttctttcctcccatcttcctcttcctcttttctagcctcttttccttccttttcttcttaagatactaagataataatttattaatttacattggagaaatattcctgttgtatgaacaataaacacttttattttagggatcagcgatcatattaccaatttctatctactgggagcccagaaagtaattaaaaattacttgacttactcggtgaggaacagaagtctcctcacaacagccacataattaaacttggaaaaggattctctcccccagccccacttcaaggcatgagaagatggtaggttcaattgacattttaactgagagcttataagagccagaaccacccagcaaagttgctcctagactcctaaaactttgaaactgtatgagataataaatctttgttcctaatgttaaactgctaagtttgtggtaatttgataccgagcagtagaaagcaaatacagtccatatcaacaatgtgttctctctttacagacaaggaggaaaaaatggaacttataaattgatcataacaaataagtatttaacataaaatgcaagtggtaatgaatcaagtgacagcaaatatttaaaaaccaaagtgttattattaatatggctatagtcataaatgttagttgtacaaattcaaatagtatacatactatgaagtataatttaaactgtctgtcttccatgccccagttctatgtggcaaaaccagcaatatgaatttctctaagactatgcctgtatatatataagcaggcatatagtgataccatatcttgcctcagtggttctcaaagtgtggtactagaatcagcagcatcagcactacctgaaacttgttggaaatacaaagttttgggtcttggccatgacttaaatcaaaatttctgaaggagggcacagcaatctgtgttttaacaaaatattcaggtgattctgatgcataataaagtctttggactctacatattactctgcaatctgctcctttcactttgcagaccttgaataacttttcatgtcattgaatagatgtctgacacattctttaaactgccatctggtcctttatcttatgtacataccacacttcattaaacaatctcacattgatctctgtttccaagtttctttagcgtcataaacaaaattaaaataaaaagccttgtattatgatatatgtatatatctaaatgtgcatgcacatacacatatacatatatagctaccacatatacaaaaaactttataaaaaattctctaggagaaattcttagaagttatattgttgggtctaagagtaagtacattttaaatttgggcaaatttgataaattatcttcaaaaatagtacatcagtgtttattagtaggtctaatcttgaaatctgcttccatctcaaggattattaacatttaaatgtcactttgatgggctaaaaccattactccctttatactgcatttctttatttatgagtaacattaagcatttttcatagttttattgacttttttctcctatgaactccctttttcagataagatcctttccaaaatgaagattacaacaaagagcttattctgactagtttgggaagtcattacaaggtttgaggaaaactcacattatgagcatgctgccgattgccttgagtgttttcttgtgatttgtgagtagtgattgatcataatcaaaaaattaatcaccagtcagccctagtgattaagtcacagtcatatttgcatatgtctgaaaatttgtgcaacctatagagacggaaatttagatgaaagttatcgatcatggaagctgtgccaaaggtgtcagtcacgggtatggggatttttactgcagcatggctagatccctaatggttagctcactggatgaaagggaacaggctgggagagggatgtctatgtacagattagtggtttgtttcgcttttctttttttttttttttttttttggagatggagtctcgccctgtcgcccaggctggagtgcagtggtgtgatctcggctcactgcaacctccgcctcctgggttcaagcgattctcctgcctcagcctccttagtagctgggattacaggcatgtgccaccatgcctggctaattttttgtatttatagcagagacgggcttttgccatgttggtcaggctggtctccaactcctgaccttaggtgatccgcccgccttggcctcccaaagtgctgggattacaggcatgagccaccacacccacacacagcctactgttgtttttttttttttgattttttgtttttgtttttttcccctgctagttatacatgtcaccattttaccaatgggttattttgatttcaaagaccatggtgagaaaaatacggacagttcagggcaaatctaactctactgctcaggtagagctcagagtgtaccggcatagaataagtctgaaacaccaacatcatgagctgatttagaataaggtcagcaaacattttctgtaaagggccagatagtattaataaatatttttggctctctggccatacagtctctgctataattgcttaactttgcagtcatacctctaaagcagtcattgacaacacaaaaatgaatgtgcctttatttgcaaaaaagcaggcagtgagccaaatttggcccatgaaccatcgtttactggtccctggtttagataattttagtgttcattactaaatgaccaagagtttgtagatcatacctacagtcaaacatgaatttttcctagtattcttccttcccctacttgttctctttgtttatttttccttctgttttacgttctccctcttcttttcctcttcttttaaataactgggtaatgtgaagggatgatttcttaacatctctgtatctcaatttctaaatctatcaaatgttaataataatagaacaaaataaaagagttagtgtgaagagtaagttaaactaaaaaaaaaaaaaattctagaaaatgctttgagagatatacacatctgcctatatgtgtgcctaagtgtgaaatctcaagatggagaagaaataaaagcaagaaataatatttctgaaatgaaatatttagttttcacacattggagcattctttaatccaagttctcatccattatacaatggcaacatgttttatatattgtacaagctgtaagctgtgaagtgggtgcttttctccttctggcattctcgttctgcctggtagatggagagctctccattcttttcacctggagccagagcatctgctatagacccactgctatttacttggtggagataaactgtgtatcatctgtctacctagaatggatctacgttaatctgaatcaaacttgattttgcaacaatttgagcactttctattgggtagatggacatttcaccagtccacaagttctagctgtatgttgttccaactatagattctgaattctgtgccatctccactagttcttgcttaagtcctaatatgacaacatggcatcctgaaatatgaacaggcaatctgaaggaagttgaaaaatacatgcttataatcacacagctctgatgtcactttaagtagagtcagtattacttttgttgttatgggttgagttttctcctctcaaagtttatacactggagttttaaactctatgcctcagaatgtgcccttatttggaaatagagtcatggcagatataactagttaaggtgaggacatactagagatgaattggcccctaatgcaatatgactgatgtccttattaaaaaaagagaaattttgagaaagacaaatacacagggagaacgccatgtgaaaatgaaggcagagatcagagtgatgcatctgcaagccacaaaacaccaagattcccaacaaaccagaaggaaggaagaagcatgaagaagaatcttcctcacagtcttcaaaaggaaccaaccctattgataccttgatcttggactcccagcttctagaactgtgagacagtcagtttctgttgtttagccaccaattcttttgtactttttaaacagtagccctagaaaactaatgcatttgtaattatactcttaataatagtagtaataataaatcacaaaaaactctgtattgaacaatagttatgcaccagccatgtgctaggtctttttgtgcattattttaatttttgtcctcccaaatgcccctatgagataggtaccactattatccgcattgcatagacaaggaaacccaggtttaaagcttaaagggtttaaatattattttcagggtcacacagatgagaagaggtggagcaaggatttgaaccaggccatcttaatgccaaatcttgtggcctggtttgcttggagaatctcagggagagaaagtccattggagttattccaaggagtattcacttcccatcagcctcagtaaatgagaagtaataagagatatggaaagtgtgatgttgacaatgcagcagttaagtgggagagagaagtgcaaatggacaggtggttatttgtggtgctgctgattcagatctcaggctcacaggtctgagtcatttatttgtttgtcctccaatgttctgtgcttgaaagcaatcaaggtactggccctgtaccagcttccctgagtctgaggtctctccctgtaatcactggcctgttcttctgcacaacagttctggtcatgaattcaatcatgaccactcctttcttcattaggcccctatggaagccgctgaaaatcacacccaaaaccagttttaaggcttgagtccatcatgctgagagccagcaggtcaggccagaactaagttcaggggttaactggaatcagaagttcggaacctattaaattgtccaattaattatgtgtgactcctcccttttcctctccctttttgtcttcacacctgagcaatggacagtaaaaaaaaaaaaagcggggggcttgctgcacacagatgtccacctttaacctgagaagtcagcagcacttatctatcattgcggtcaccctagaaaacataaatccagattctcggtggtctgggaaatggtgctttggagaagagcgagcttgtggcataaactcagggtcctcccctaatcttgaggactgcaagcttaggtgttatctagagaaagtgtctagaggcagataattgatgctttactcacagtctggctacaaaggctcaaggcaggcagacatgagtttccctcctcgccatactcactagtcaagtgcctttgagtaagttttgtatcttctttttcctcgtatacctgactcacaaaatgggatatacagaccttgtggtgattgtgaaaataaaatgaaatgttgcctccaaagcacttagcacagtaattgaagatgcagcactttctgagttaaggccagttccttgtgaatactttgctgttgacaacacaagcctgcttcttccctctccttcctcctctctgttgtgacaaactgcacgacaatggctccaggtcctgactgatcccttatgttaatggtcctgactcctaagacagcttcccagatgctgtcagacctcagcacaaattattggcttgaacttcactctttacagaaagatgggtcccatgtggaatggatctcagcttccagaattcactgaggggtcctttcctgctcgtttactaggtgggcccccattggcctgagggagctaatatgtttcacagcgtgttttgtagattgcatctggccagatgtttctctgtgtgggttcccttaagcaatgtgggagggaaggaacaccctgatgtacatggaatttcagccaagaggcctggtgttgcatcgccttggtctagaccaacctctttttttgttgctcccagggagcaagattgtattccagaatgaaagctcagaggcagtggacccaaggccacttttctccccttccattaggcacatgtcaaagactacttctattgatgacacagccttcagcttctgggatatacttcaagaaaggagcccaaatacaggctgttataaaacattgtcatagtcatgccccaaggtggccacgcaaagggtacttgatagtggccaggaaaaccatatagcttgttttacagggacagtctactccggaatcccatccagtcctatgcagcatccaatgcaacattcccgccttccactcaatttcagtctgagagtatatgaaatcttaattatggctcagagtcaaagcttttccacccaggagttcagcagagatacatgttcttcatcagaggggtagattatggagggcaccagcatccccaatccaggagctgaagggcagctgtagaatgctgtcaccgaggtgtcagttatttaaccaaacagaggagacccacaaaaagtaaagagaaggctgtctggccagacttagaaaaaaaattagggatattgtgtttctctctcttggttgagggatctggatttttaaatctaaattacatttatgggtgctaccatgtgtgaggcttggtggaagatgctggtgaggccaaactccctggtcctgcttccttgtaccagtgtttcatcaaagacagaaggattgggtgtcgtggtttcccagaccacagtagcctagagaatgtgattttagactgggtttaagaataaagggatgagggacagcagcgtagtagtagcacaacaacgacaacactaacagacaacagagaaggcgaaatggctcctgtaagtgaggcactttgtatgtgccattcctgtgctgagatctttataggcatcatcccattttattgttacaaatccaactgagctggtgcgtattataacagaggagaaaataggtgctgagagaaagaagaaatgacttgcccaatgtcacacagtcaggaagtagtaaagccatttcttgaatctaggtgtgcaaagcctgagctcttagctgtcatgtcacctgccttctggagatgtattagtttgcaattttctgtatttctaggacacatcctcccccagactttaagctgggttaagtctctgctttgtgccgttgttatgccgataaaactttccttggttttgcagtagctgtgcttttccctgcagagctaccacattccaggctgtaagtttggctggcattttgctcaaaaagtatgaggcacaggaaagcctctctgcaaaaaaagttaaaataattttattataacccaagtgagaaccaatgcattaccgacattcgtggtggtggtagttaaaatagtaataacagtgattggggcaggtaatactaaaaaagaaaagtagtcagagtaattataataaaacaacaatccctagggtttattaaacacttactatgtaccatttgctattgggacccctttgtatgtaataagtcattcaatcttcaccacaattctcaaggcctgaactaaagtgaagctgcgaatcccctaaggataacttttaaggaggccttcactgtcagttgtaaagagtaagggcttccttaaacgtggcaccctaggggtccctcttgcctcaccctagtcctggccctggcctagaagggttgtgggtgaaatagtcacaatcacaggaactttttgaaaaagtaaactgtaacataaaggtgttgataaattttctgggatcacacagacagcaagtaacagaattataactctaacccaagcctgtattggccaaagcctgtgtcctttgtactaagatatgcattgtttagtttctcaccatcatcttacaggaacttagtcatagcatacattctaggaccttttactggagtgttttctcagagtctctatcttcacagagtatcggagaggagagtatcaagaaatgattttatttatgtgtgcttgcatgtgtgtgtttatctgttagtggttttttttttttttttttttttttgtcacccaggctgtcccagactcaagcaatcctcccacctcaccctcatcaccctcctgagtaggtgggactacaggcacccaccaccatgcctggctaatttttgtattttttgtagagatgaggtttctcgatgttgcccaggctagtctagatctcttgggctcaaacaattcttttgcctcagcctcccaaagagctgggattacaggtgtacaccatcatgccaggccaagaaatatttaaacagggaagagaaagaggaagagaagaaaagaagataaggaaggaaggaaggaaggaaggaaggaaggaaagaaggaaggaaggaaggaaggaaaggttgattcagaagtcagtgtgaggagatacatactgaatctcacctcatattgtctctctctgtgtactaggcagaaaaattttttagttcccatgacataaacccaactcacagtagctcaggcaaaaggtgagatttattttttaaatgtaggattatagaacacattaagagaatagctaaaaccaaactacaggtaaggcacaggtaatgctggtttcaggaataaaatagggaaacaaatatccttttcctttctctctcgctccctctctctctgtctccatcatcatcaccatcaccagcatcgtcaccatcaccatcatcatcaccatcatcatcatttccacaaggcttatagggtttctgcttaaatagaatcttggacaacctcaactgaaatttcacactggaattctcatggtaggtacacagaggaggcctcattatgtgtgtggaggcaatcatattacaagaaagaatatgataagggcatacatttatgtactgcagagtttctaggaatggagaattaacatctggcgacgaatcagagaaaatgccatgaagaatatgatatgatagcatggatgggattttaacaagtaaaagtatgaaaccaagacttagacagggagggcatagcaatgagaaattctcagaacaatacttcataaaacagtcagtcaattacaagctgttgtatttgactagatcatagattataaatcatggtattgtggggcattaggcaaaaaaagtgaaaatattgtagtggaagtcttcgaatagatggaacaatgttattcacttgttcattcattcactcacttattcataattaatatttattgtacacctattagtcacctactaagtctgttggtgcaaagatatttgcggaacatgaataatcccaggttagagccattgatcatgtgaataggagctacaagtaactaagcatagctgattgttcagatattatcaaatagtcctcctaatctgggagttttatacagtattgacatgccgacaaagtggaaagccataacttgcatctggctttcaatgcagagactatgtgtgaaggaatcaaggagctcagaagcttttcaaacaggggaataatatgtgattccatttagtaacttaatactagtggctatagccaggagaaattggacttgggagattatggaagcagaaagaggtgtgtgtgtgtgtgtgtgacagagagagagagagagagagaaagtttttacaagagtttgggtaggaagaagcaataatttgatagatataaagcacacatttgggaatcaaagaggaccatggaagaacatttttagaggacttgatagcctgttgggtatgttgcctattaagggagattgaggactttggtgtctgggtggatgttgatgccgctgaaccaaacagagagacaaaaattaggagccagtgtgagaaacagcaaggaggtaggaggtaggatccgtgatattataaatttaacaggagaagctgtaagttgactagacagcattgaaattggacaaggaggctgagattggagatatcaatttagtcttcagtctacagtggcccttctccatcaggtttcaaaaaaaaaaaaagtaaacacactaatgtcttaaggcatccattgtacgtaatgaattaacttgcttccatgaatggaaaagaagattagctccctaccatctctgtgaagactgaggaaagggtaactcaaatcactttttagggcttaattttctcacatgattttatttgagaaacgttgatgttaagataatagttgctaaaaatggaggttaatgaagacattaataaaaagagtataactcatgtataaagggacctagggtaaaaagattaggtaggtctaatatttaggaagcaagagggaaaataaaggaactggtatggcaaaaaagaaggagtggccaaagaaatcacagaagaggctgggcaccgtggcttacgcatgtaatcccagcactttgggaggacaaggcgggaggatcacgaggtcaagagaccagcctgtccaacatggtgaaaccctgtctctactaaaaatacacaaattagccaggcatggtggcacacgtctgtaatcccagctactcaggaggctgaggcaggaaaattgcttgaacccgggaggcagaggttgcagtgagtggaaatcgcgccactgtactccagcctggggcgacagacagagtgagactctgtctcaaaaaaaaaaaaaaaaaaaaaagaaagaaataagagaagaaatgacccccatgccattgtttatgcagacatgccaaaaatgtcccttcagaacacacaaaattccctctgcgtgtctttattgccatatttactgtattattttgattagttactatcttatctctaactaaaccttgaagcaaagaccacattacatgtattcttgtggccccattttgtagacatagagctgtgccactcagatcctcattcatggaagaacttgtcccaactctcagctcctgcagaatctgcctcagctgcaggaatgtgctttgtccaagggtatgcatctcccatggcagcccatagccagtgggctgatcaaggtgcggtaaaaaggcctggtagcttcatcccaatgtggaaaactctgatgggatgtattccagagcttcccatgggccactccagagcttctcctaggtcgtccaagtcagacctctaccacaagctgactactccatccacctaattttgcttcttgcttctcccttccaaaagtgtctatccctaataaaacattgtatgttaaaccctgtcttagcgtctgctgtgaaagacctagccattaagtctagatactgagaaagtcctcagtagctagaacaagatctaacatacaaaaagagattagtacctttggtgtagagaaacaagttgtgacctcaaagttgcatattttattcatctgttcaatacaagttaagcatctactgtgtgacagactgtgttctaggcaccagatttttacatagatggaattggtctttggtgtctttaagaacagtcaatcagggcaggggcactaataaaggattataaaatgctaaggaggatgggagttgaggtgggtcagtgctgtgttaaatataacccattatactgaggttagtaacttttttttcaagagttatagaagggcaagaacagaaagagatgaggtattgctcaaaatggcatggatgagactgatattgctcatggtgtctgagatttcctttccccattggcactctacttgactatgcaccttagccttcttgcatctaggtgtggcaatgtgattatttttggccaatgtattgatgtgaacagaagaaatatgcatgacttactctcctgggccataaaactgcccactgaagattccccattttatctttccccatactgcaacagaatggagaggaatacaagggcccagagaagagcagaacctccagaggaaatgagcaaggatccctgaatgactttatggagcagagaccctctgcatagacccacactgtactctgatgtaagcaagaaccaaactgttgtttataaaactactaagattttggagttgtttgggaaattaggtagcacactccaactaatatatgtggtataaaatttaaaagaaaatttttttccttagagtaggctagtcttgactacatttagaggctaagggtatggtgccatgaaatataaattgaagaagcaaatgagagaatggataatcgttagagcaagttccctgcggcacagaaggaagtgacccagaacaggatcttctgttctcctgtgctttgttgtcaagaaagagaagaatattggtcatttttgttttagtgcttttactactaattattaactagagagaaatgatgaaaaaagaacaaggataacaaatatatcaaaataacaaaggttcaagaaccttttcatgttattacacacatggtgtgtttcaggaaaaaaaaatcatagcaaggaaaatgtgagtttaaatcctggctttgcaatatttttgttgtaaaatatgaagacagtgcattctgagattattcacttggttcagttgagacacaggtaaactgatgtacatctcatatggattacttttttgtgtgtgaaaacaaaattagatctcatgtcattagcacaggaaatggaatattttgaaaattataacaatagctaatctttattgaacagttattctgtgtcaagtactgttctaagcaaatataagcattaagtaatctatttctcataacaactcaatgaagtattgttcttttactacacccattttatagataaggaaattcactcacaaaatattaattgccagtgcttttctttgggtagagagattatgggtatatatttcttaatattttcatattttataagattgcctatgtggcttttatatttacaatataaatgctattttaaaaacaatgacaatattaggcttaattttcttttaaagaaaccagaagtatggctcttgaatgtgacatttaccaaaccccgactctgctaaggcatttgcaaaggccctgaggccatcctccaatataccttaatggcacatagacttggtggtataatcaaccaaattagatcagtgcctgctctttgccctctgaatctccagctttggtggcacccagatcagtatgacaaacccttctaggcttctttctatggaaagtcttatgggtggtttttcgctggataactgagtgctcttggaacatgctgttgaacctccctcacgtcaccctcctgtaaaaaggatgtgttggttgagtatcccccaaagtctgactttgagataggaatttcagcataagtagtttatctgggttgcgaccccagcaggcacagtgagggggtggagaaatgagtcagggaaaggaagagaggcaataaaagtggtattaactagtgtgttatcgctacaggaagatgggcctcaattccattggggactcctaagagcctgtgcagaacataccttggaactggcctgctatggggcaaagaagttggaatgtcattcatcaacatcaccaacttttatccttaattattataaggttacccttggtggtgtcaacaccttcaggtttctgggtgtccagcgcagtgggccacagttctcctgtggccagaggacattctgtggcagagagacacaatttcctttgacgtatatggggattcttgttaggtgacctctggggtaagctgatgggggacagggccagacaccaacagtatctgctacagatgttaaaaaaataaataagatgacacatttaaggatttagcatataaatgcttaataaatgctagctgccataattaaaatgatagcattagcactatcataactagtgcagaactcatattaaaatccaagttttgtgaattctggtctcagagtattttaattaatgggggaatcttcatgtttctttttcatggttgtatttccctcgtttaatctttatgtttgtgtaaactaaccctcagttctccattcttagggtaggaataattaaatgggaaccatttttgcagactaaattttccatctctgaaattctgtgcttcaccttaggaaaacccccaaactaacattagctactattgttgttttatttctttaagccatgccacttatggctctggggtcaggagatagacatcttgtttttatgaaggctcccaaggggtgaactgcagtcaaaccacgtttccctggaagacttcaagccattttagctgctcaatggagaacacatcccaggatgcaggcaggtttccaagacaactgggggtttgattgttcatagaaggatggccaaagcagctgcatattggtgctttggaagtctcaaactattccacaagagctttgagttctgtaaatccaaaacatatttgctacaaatatttttcttttcattttttaatcacatatatattacaagggaaatatattccatctgattttttttactcacttatattgtccaaatgaaattttgaaatgtatttgatgttctataatttaaagaaaaattcactataatggaaaaacatatttggtaaaaggcaagtgcttctgctcttcatgctgctagtgactgtgggtcactgaagtggcctcagagtcaacacaatgaattggccatgtcgtggattcctttgaaggatggttccagctctctcagtggcagatacaatgggtaacaaagggctcatctaattctattaatcacagaaacttggcaaagagaagagtatggcataaagaggttcaaggacctgaaataccagtgagtccaacctcactttattttacagctgaggaaactgagccccagaggggagaaattctttgcctaatgacacatggttaattaaaggcagatttggggtcataaacttaggtctcctgagactaggagcagggtaccagtattctttctactgtctgtgctgtaaagcatcaaagcacaaatacaaaatctgactgcaaaactgaaatcacaagtgtgttcaagaatcatgggctgttatgaattttggaggaacagggaatacagaagttttaaaaacagactctccttcaaagagcacaggctctggggtaggctgtgatgtgctcctgttgcaattttactacctccctaatgataatgactttgggaagttacttaactgctctgagtttctgtttcctaatctgaaaaatgggttaaaattagcatccacacatcagattgtcatgaaagttagataaaaacctggatataaaaacacttgctacagtggctaccatggagcaaatattaaaaataaaacaaataaaaacctttttaaaaaaagtattactattaacattattattcaatgatcttactttccaggacagtgcttcctaaaactgtgttttgtagaacactaataccagacgatggatgtgaattgatgtttgggtttgtgtttgtttgtttgtttttgttgttgttttgagacaagatctcactatgtcacccaacctggagtgtagtggcatgattatagctcactgcagcctcaaactcttggggctcaagcaatccttcctcctcagcctcctgagactacaggcaaacaccaccacatcctgtccagctaatttatttattttttgtatgtggagacaggttttcactgtgttgcccaggctggtcgtgcactcctggcctcaagcgatccacataggcctcccaagtgggattacaggagtgagccaccatgtccagtctgtgaactgatataacaaacaaataagtgcaaagaaaatatcctatatttcagtgtgttttgaaaatacatactccactgttttcttggctattcttaatgcataatatgcaactggtagtctgtaagaaagcattcaggagagaacactattaaattgtgttgaatgtaatgtaaccaaaaatcatgtatttttctttttaataacatgcataaattaatactgtatgcaatagcattctgttatatatcagttatgagaatgtcagtgtaggagagataataggtagacacaaagctataatgcacatggatcatgatccatcatcaaaagatgtgtaaaggtgactgccaagaagcattcctcttccaaatgtgtctgcttcatggattcttcatgaaggaaaaattattacagcagaagagggttaggggttactcagagattgaagtgaggaagttcctggacacaaaagtaagaaagtgctgaggaagttttggagaacagcaaaaatccaactttacaccttcagcagtgggcaggatttgggggaagcactggctagagattgtgggaccagcttatcttccttttcttttccaagggccggaagtatgcagggtttatttttacatttacaacacctagtgcagggtctggcactaagtaggactcaataaatgtgcactgagttgagaccagatctaagtggatgtgaaaagccatgacaaggaatctggatgctatttggcaggcaatggagagcccttgaagcttgctgctcaggggagtgacatattcagaaaagtacttagagagatcggtttggcaccaggtagaagatggaaccaaggagaaagaaactggaggcaagaataaatccagaatccatgcactattttaaacaagaagcaactgaactcatggatggacagaggagtggagatgcagacaaaagagcagctgcagaggtagaaaactaacagaaccttcagtaataatatttcttaagttaaaagaggaaaattaacagggtttcatcaatgatttcttattgtgcaaagaaaaagagatgaatcttgagactctgagctctggttctcttaaaagtgagagaatggtagtgtcaaggacagtcaaaacgagtggggaaagtagactgttcgaactgtgtagaaagatgagcccagatttgaactttgagtcaagcttgaggagctgacaggaaatagggcagataatcagaaagaacttggaaatgtgcaacagaaacatggaggataaattaaaaatgaaaatgtatatctgggatccacctgcatggagctgagatccgatgttccgtgagtagataggagggtgatttagagacttgagggaaaggaaagtgaaagtcaggagcatcatttcccaccattgtccacagctgcagcctgacacagcttgttccatgcccaccccctggaggcagatggctacgtgcaatcacaccgctgtccagtgcctgagtcaaccctttagctctggtctagctccccctaggggtggagtttgagcatggtcttgctgttttgtctaggggcagccctaaacactcacctgcccactcaattgaattttttccctgcccctgtagttgtcttcagaatgcagtctcctaaataagactacttggatttgaacttcagcactagaagaatggaagagttttttttttttttaacttctctcttccttttcataaataaaaataatatgtatgtgatagtgtttgcttatgaagagtaaatgtaaagcatttggaaaattcttgacatatagtagaagcttaatatatttttcccattattatctgttttatcacaccagttatttgtgcttagtactgatgcctgggcttatgactcagttttcgtgaaattattagaaacctgccctgaagctctgttcccgttgcaaaacaaacaaaactcagtttaacttgggtcacctccagagtcaggctcttgtccaccctaacccctgtttcgagactgtactgactcttgtcatcataggagaacagaaacttccgcacccctcccatcactcactcatttattaatttattgaatcacccattcaactaagatttattaagcattcactttgtgatgggcactctgtctacaactaccaggtaacactatctggaaactgaggtagccatgcctttgctattctggacactgtaatactgtaaccctccactgcagccaccatgacagcaggaaggattgacactctatcctcacatgaatttccagtgtgctttgaggttgagccaccaaactcctccagcaaactgccttcttttatttatttatttatttatttatttatttatttatttattattattatactttaagttttagggtacatgtgcacaatgtgcaggttagttacatatgtatacatgtgccatgctggtgcgctgcacccactaactcgtcatctagcattaggtatatctccaatgctatccctctcccctccccccaccccacaacagtccccagagtgtgatgttccccttcctgtgtccatgtgttctcattgttcaaaatgatgagttcatgtcctttgtagggacatggatgaaattggaaatcatcattctcagtaaactatcgcaagaacaaaaaaaaccaaacaccgcatattctcactcataggtgggaattgaacaaactgccttcttatatctccccagactcatgagcaaatggtagcacagggtaaaagcccaggaagttcatgctgatgccttgggaggatacacaagagggtcagtactgcttttaccccatgatgatgcaggcaagaagacatccatcctcccatatctgtttacatcagccctgatgcctcataaaacttccccccatacagtcattaacgaggtggtaacaaggatatcaggggcccaggggagacactctgtttgatgttctggatgaaggaaatgcagacttgctctttgtgaaagtatgagggctaacttggaggcctgcctgacagtccctgtaagctcagacatgaagtcaggggaatacaattgtgtgaaagaagcagaacagtgaagtgttgagatggcaaaatttggaagcccaagggcagggagcagaacaggaaaaacaggcataagagttttccatgtgggtaacataaaatgattagtgacatccacatcaacagaaggctccctgttctttgcttgtggtgtgtttttgtgtagacatccacacttccgatccacagtgaagcctacaaaggggctgagcactcttcctgcagtgaacttatacatgtgcaattgtacgtgtctttatttttctctttgttatttgtgctgcatttaaccctatggctggaacattataaatgttgaaaactttgttgaatgaataaagaaataaatggctcaaagatgggaccatttagcaggaagaaggacctgccaaccttctttttctcttttttgtctatggaaccagacaagggcaaaggatagggaagtggcactggggaattccactctagaatgtccttgagactcccagtcattggtagggctgatgcttaccggaccttctggtgccaaagatcaatgtcaccataaccagggtaatgtggggaaggcagacctcagtcctcagcccagaaatggcaagttcttctcaccccacatcctctcacactcagggctggcagcttttgaatggggaaggaccctttgttctacccaaagatgatcatctaaatcagaccaacagtccagctgggacatccacatataccttagtattctctagtatttattagaaattgggcaactctttaccttctaggaacaatctgcagttgtgtggaaggatcattgacattgtaatatcgacagcaaatagcttttgagcacttatttgcgtgggatacttttaaaatcttctacagccattatctcatgtgtcatcacaacatccaagaggcaggaacctttactcctcttgtttagtacataaggaaaatgaggtctggagaggtaaattaacttttttatggttacaatgcaagctattggcaaatctgaactgaatccaggaattcagccttctaagcaacgctcttaagcattgcactgaataattagactcatgtttatatctaactttacatctagcactagatgactttgtggttttaggtctattacatgcactagcctccactgttcttatctataaatggaaaacatagtgtgtcccacgattcttgtaaggatatgtgctagacacctcatcagagcagtgtccagcatataggaggttactttcattcccatcactttggtcattaggagaaactcatgaggaatgttttggtctccagttctgccgagtctgtctcttcctggatctgcgagtatatatgatggtactcttttcccctggcaagagaagggcagctgggaaactgttgcctctcaggataaaggagaattatcttcgaggagtgccaagtgcgtgcttattcataaaacaaacatttatggagcttcaacaagagtctgggcagcagcaactatagcgtcagggactgtgcagttggttcattagaagctgaagcccccctggaggcctgcagggagcgggcctggaagggggagtggagtgcaaaggccagctggttctctggcaacaaagtcaacatcgccccagatgtctgccctgaggttgaggccattagctccagtttacctgttcacttcatttttcaaaattagccacaaaagcctcccacggaaacacaatgggcagcatttctcagcgggggcaaaaagaaaacaaagcatatctttccatgcacttgtttggagtttctgaatgtcccccagagccctggaggcttggcaggcacgatttggattgctcccacatggatgtctgtggaagccccacttttctttcctctcccagattcaccccagctaaggccaggctgtcccacccctgtcatcagccttgcctgagcaccccaaccctaaacccaggaagacaatgactttctcattttcttgctcctttttcctaggggataatattacagtttaaattcctgggttgactttgagagttgctgggagatggtattagctttcaaccacctgatttaatctcttctctcactcccaccttcccccactgctgttcagacaaggcagagggcaaaggggagaggtgaggaggttaaacgcttgactgcagagacatcttttcatcaggttttgttgagagcagggcagacaggagtagccagggtgtccgtagggcaatgacagcttgtgtctgtctcttgctgactgtacagccccatatgaacttatatgggagaaatggggagagagggccaagagaatgtaatgatgaaaagaaagatgaacaaaaatataaatactgaagtataaggctgtgcagttggagctgtccagtgcaaaatacatttttgccctaagacagttctctctaacctaaaaatcaatagaaagttatgcaataacctactgtgtgctaaaaaaaaaaaaaaaacttgccccaaataaaaataaattgaaaatattggtaggagaaaaaacagcttctttaaacacaggccaaatgcaaaacaagtgaagagagaaccctcagatgtgatttattggtttctatttttaatctttggggagtcaagggaataggagagatgccaggagtttggaaactggatacaaggaatgtttttatttacacatgatttagctactaattaaatgtgtcgtttactgtctatcctgcctggaatgtaagtaccaaaaggacagggacttctgcttgcatcttttccattgaaatatcccagtgcagagaagtgtgttcgatttgtagtaggtttggaacactatgtgttaattgagtaaatgacaggaaatagaggtgagtctgcagcttccctcagcaaggtgtttttcaggactactgtttgcaggccaggtaattgtgggggtctcttcttggtttgagtctctatttggagctcccaaacttctctcctcactatgtgtgtgtaatgtatgttttcttgtctttactaaagaagttagtgaaagattttagtatcctctgactcaccatcctcctgacttcaagagctctttctttctgcgtcgtccttggctctggtcttaaactcaagctactttgggtagtgtagtaggctgaacaacaggccccaacaggcatcagttcctaatccttacaaccttaagtgttcccttattagggaaaaggatctttgcatatgtgactaaggatcttgacctgggaagaatatcctgttttatccaggtggttcttaaattcaatcataaatgtctttataagagagagaaaaaggacatttgataaactcagcgatgaagacaatgtgaagatggaggcagaaatttaagcgatgcagccaccagaagctggaaggggcagggaaggaattcttcactgagcctccagggacagtgtgttcctgctaacaccttaattttgtcccagtgaaactgatcttgaactctggcctccagaactatgagggaatacatttctgttgttttaagacacccagtttggggtaatttgtttcagcagtcataggaatctaattcaggaatgctaccctactcttttcccttggagcagagctaagggcttagtcagaggtaaggctggtcagaactgaagagagactggaattaaggacaagaagttggaactgggggctggtgcagtaaagtaaagccagttgctctaagacacgaatggtgaaatcttaatgctgtaacacaatatacatttacatattgctcttataaagcccggttggcagcaatggtgagggtggagattctgtttcatgagaaggactcaactgatggaggctcagccatccttactgcatgattttattgtaacttttgagttcagtggtacatgagcaggtttattatataggtaaacttgtgtcatgggggcatgttgtacaaatgatttcatcaccaaggatcaccgaggtattaagcctagtaccttttatttatttttcctgattctctcccttctcccaccctccatcctccaatacagcccagtgtgtgttgttcccctctatgtgtccatgtgttctcaacatttagctcccacttataagtgagaacactttaattgatgacttttgaggttgtcttgggcatctgcatcaaggactcagatgaagatgggggaaagaggggggccaaagggtatttataatccaagcctgcaaatggcatacattacttctacccatattctatgaagtataacttagtcatattaccccacctagatgcaagaggtctgggaaatctagttcctgctagggtggctatattccaaccacaattttatattatggagaagaagcatgagttcttaatggacaacaagccaagttctcaacaaaaagagagaaatgctacaaaggcaaagggactaaaataaaaacagggtagtttaactcaatatgagtttcatttcaaaagtcacacaaaatattatgaagtagaatataaaattcacatgagtttttaagatatgaataaaaaacataaagcaaatctgcctttattattcatttttgagaagacttctcatccagtaggcttatgtatctactcccctatgccttgcactgctgagaatgtaaacacagagtctgcaaccagcaagaccagggtgcacattctatttcctttacttacttacgtgtgtgaccttgagaaattatttcactgttcttaagcttttatttctttatatttgggaacaggggagtttctggaggtcacactatcttcaggatacaaagacgagatatagagaagaaaactgcctaaagcatgcgcctgtagtcccagctactcgggatgctgaggcaggagaatcacttgaaccctgaacccaggagacagaagttgcagtgagctgagatcatgccactgcactccagcctgggagacagagggagactccgtctcaaaaaaccaaacaaacaaacaacaacaacaaaaaaagaaaaaaacaaaaaacaaaaacaaacaaaaaactgcttaaagtatttatttctgcaccttcaagagtgggatgagtcaagatcatacttgaaatctgagcaaacatagttgagtggccaacagaaactacaatgcacatacctcacttcctgattaatgggcctccctcctggcaaggatgctaggaagagacactggtagcctggtgagtgccacctaggggatgcatggggagcagtttgtgggtgcaaagaaaatgatgaggtcgatgatttgcatttataaagaattaacttggctgggagcggtggctcgtgcctgtaatcccagcactttgggaggccaagacagaagtatcgcttgagccaaggagtttgagatcagcctgggcaacataggaagactccagctctacaaaaaataaaataaaataaattagtgtgtgtggtggtgtgtgcctgtggtctcagctactcaggagtctgaggtaggaggatatcttgagcccaggaagtcaaggctggagtgagctatgatcccacaactgtactctagcctgggtgacagagtgagacctccctcaaaaaaaaaaaaaaaaaaaaaattaacttgagactatctgctccaaagagcttctagatactgttttgtttatttgttgtttgtgccacgatctcgagagcatgtagataattaatcctgaagttgcacatccgcattctatcttctgttcaattcattcatgtaattaaccagaaggaattgtgatataagaaaagaattttacaaaaatgctgctcttcatgggacagttaacctagaaacggaactgtctattgcctgcaaatatttggcttttcctcttcttattaccacccaaaaggggtggctttacttatagggctacctagaggggaagaagaaccaagtcaggctaaaaatccatgacagagagtcaatgagtcaatgagtcaacacacacacacacacacacacacacacagacacacacaatatttaataactctaataattgatgataatatgaaagtctggaagtgtctatacaataaatatgttaaatctgactaaaattaaatgagatagcagaaaatgtaataaaaatatgatataaagaaagaaaagaaccaaatactacttctagaaaagaatagagaaaataaagactttttttttaaagccttcatgaacaaattaaacaccagaatagacacagctgaagagagaacctatgaactggaaaacagatctgaatgcagcactacaaaataaaaaggtgattgatatgtatcgtcaggtctaaattgcaagagatggccaacactggtgaaaaagtagtctactaagaagcctgacaactgcactgagtaaaatatgaggcatggtttgggacaagatgttcagaactaatactaggaacatgagtgggagctggagttttgtttatacattgttgcatagtggtggcattccctaaccccaattctgtgtgaccatgatctttttggtactgtgtacatgcagtctctcacagaattacttcaactggtggtgttactgagagacactgaaacagcaatagtttattcactgaatttttctttaaacacagatctgtatattagttttttaaaagaatattaataataaaattatattttatatgccttcttaaatggtgttcactaatgtcaggcttaggagaaaatatttaagattcagtaggaacctagtaaaactagggctataattataatggaaactgcataaatcgctccctctcttactcctacagccagcaagacctcttagggagttccaggtggatgggaaaaggggaccaaatgagttcatcaccagaagcaggcctcagaagagaaggtaagactcactcatctcctggtgggcatattcttgcacataaaaaggtcagtatgtgaaaggaaagttcttggctactaacgctgcaaccagacacttcctgctgaaaaatctcagaaacccctcactctcacctcacactatcagggctgctattttcagctgtccctctgccctatttgccttcatgcctcagaaggcacagaaatcatagccaaagtttgagctgacaaatgttcataaaaccaaagaattcccaagcaggattttgagcttgaccttagagcagttggtcaagttggagatatatttttaatgtaaatatttctggtaacatgagcttgggatttatgccagcaaagcttctgaggggccttttctcaccctgtgctctgtgcataagtttctccttcttagacacttttcctctgtttaggaacaaactttgttttatgatccctaaagcagttagcaaactgatgacttttctaaagctgaggatgaaagaccatataacaggttgcagagattaagttgaggtccttaagaaacagcttctggtctagatttgacacatttgcagacacttggttctaaactattgttaagcattagaaaagccttgctcgcttatgcacaatacattctaaaatggacttgaggtagctaaaacatataacattaagaaagagcgttagaaatatacaaacaatcagaacctttggagaattaattatgctaaatttaagactaatggagttattacatttgggtaatgcttttgagcttcctggtggccagagttaaaagaaaagtctaacaaaaagaggaaatagaatgatttttagggagaaataatatattatttttcattttatgtatcttgccacagatacagttgaaaagaaatatattacataaaaccttctaatgggggcactaataggtacaatggaaaacgccctctgcagcaacgttaaaactaagacaaaattggtttttaaatgtttgtttgataaatcaactttgatgtttaataaagaactagggtacatagaaattattcaaaaattagttgttgaatgaatgattaaaaagatttaaaagtgttcattttatttaatgacccgataacttctgatggaattaaccagacactatttcctggagtgatggtaatgaaaaccaaattggagtaaagttcttggaaatggatgtagtgatgcagacacctttttgagaatgctgctgttaaaaaaacacagaaaaatagaggaaagtaaaatcaaagatttttttttttaagaaaagagagatttgagcagatgatattctgggaggatccactgtagaaagagtgcaaagttagggatgaaacaaagttgaatggcatctagagcacaggtgggtggaggaactggcctcagacagaaatatggaacctcttagagttgcttttgatctgggtttggtagcattacctgcattgtatttccaccaatgtgaacaattttatgattttttaaatgagttatactgaactttgctttcagatgccgttagggaaactgtgggaaaagcagctaatattctctctccaccctccttcaaatggggccattttctattcccttttaatagttgaatgatttataataagggaaactgtgggaaaagcagctaatattctctctccaccctccttcaaatggggccattttctatcccttttaatagttgaatgatttataataagcatatattactttttaagtaaaaataagtcataataacattgccaaaaaaatttcttcaaatgatatgttcccctttgaacataggtttgtgtattctctcatttgtttgagaaaggccaatgacctcagataatccttgaagttagcactgattttctgcttaaagatggcattgttttgaattgtctaacaatgggtaatctaaatattatttattttatgtttttggatataagttttaggagaattaaaatacatgaaaactatgattgaatataggaagacaagttgtatagtatttataggagaaaattccagcaatagtctcaattgtttgagacttctcactttgtgataaaaattgctcctgtcatcactgtcactgatcttatagacaataattttattttcatttttagagacagggtcttgctctattacccaggcttgagtgcagtggcataagcatagctcactgcaacctcgaactcctgggctccagcagtcctcttgcctcagcctcccaagtagctagaactatagacacatgccactatgcctggataattttttttgtagagacagggtctcgctatgttgttcaggctggtcttgaaatcctgggttcaagcaatcctctcacctcagcctcccaaattgctgggaatacatgcataaaccacagtgcccagccagggtctttagattaggagatttatattatttcaaacagcaaaaatacgcttgactacagacaaaactgaattttaattaaatccaaaatggatcattgaaaatttgtttattttttctgtacacacacacatacatacatgtcaacacaggggcataatttatcttccaattgtgctactttttacaaaaatagtaagaaccaaatgtttaagagtgatttatattttcagtactgatctgtatgttttgttccatgaaaactatgaaaaattttgcagtttcaaatctcaaacttttctgagtaatgggtatagtgaaattcttccatggtcatgttaaatgtttgggcaaaagcagaacatgcttgaagggatcatgctgtataaatgttcttctttctttagatgctgcagtaagcctatctctgcttctcagctagttttagaagtggcattcttaccatcctcagaacaatactcagataggtaagtggaggaagctgcctacagcaagcaagagttttagttgaccttacagaagaagagtactgctggtctcccatcccttccctgtttgtctaagactctgaaattaaaggctgatagagtgtgtttcttgttggatgcacggcgaagttcatcatgtttagcctacctgccactgggcaacctaaaaccaggtatcagaagaaaataaataataatcctggcggagaaaagtgaagagaggaaactagtgagaaagttgtgtgcacaggtgtgcctatgtacttgtgcatgtgaataccagtgggttgtttgttgcagacaaatgtcagtttaataggcacatggcagaaattcctaccacatgagttctctttcagtttgctatggaagacacaaaaacccgtgagcccatcttactggaatgcaaacgccctgagagcctggcacgtaatagctgctcagcagggggcagtgtgacacagtcattaagaacttgaagatgctgctccctctgggcctcctcttcctcatctgtaacatgggagaatcagtcttttcatacagagtcctgtaccgtttaaattagataatagattcctaaccatgggacagagtaaatattcaacaaatagtaacttttgtcatttctactttttaaattcccgttacaaaatatctccctccaagttagaatgctcattcaaatttcataactgtgtatctttgtctgggaggtcagggaacgcctccaactcaaaatatctaaaaactaactcatggccaccctgacctccctgcctggtgtttgttcagagatccctgtttcagagaacaacatccagttgttttataaacggtttgtcatccttaacacctccctctcccctactcctgccatgctaatgtgagttcttttgatttaatcacttaactccctcttggaactccccatttcttcccattgccccatcacctccacagtgtaagcagcccgtctctaccattgaagactgcagtgcagtcctaactggcctgttcctcacatcctctcttgccctcctccaatctgtttccacatggcagaaagaccactcgtgcaggaacagaaatctggccctgctgcctctgcttcaaaacctgcatcacttccccggattcttaaaatgaagaccaacatacttccacaatcactccagcttcagctggagtcaagcccctcctccccctcctttcttctctggactccactcacaccagatttgtttcagttcctcaaaagagcatggattcccctggtcacaggacctcagtgccagctgggcttccattccctgtcacacccttgaatctggctaaccctatgtacccctcagttttgttgcttcttcagaaaaacctttctgagtagaaccatctcccttttaatatgtcctcacagtacttgtacctctctctctcttttttttctttttcttttccttattaaattttattttaagttgtggggtacatgtgaagggtgtgcaggtttgttacataagtaagtgtgtgacatggtgatttgctgcacctatcaacctaccacctagttattaagcccagcatgcatgagtgtacctctcttttagaagtgtttatcactgttaatatgtaacatatattttggtagttatttgattcatatatgtttccccatcaaggtataagcttcatagggccagaggtgagaggtggggacagaactcatagttgttcacctttggatcaacattttccagtgtaataatagatgctcaatgtgtgtgtatttgtgtgtgtgtgtgtgtgtgtgtgtgtatgtgtaaggataacagctctcttttgtaccccaggactcacccaaggttttcttactttttgtttgttttgttctgttttttcgagatgggatatcactctgtcaccctgcctggagtgcagtggtgtgatctcggctcactgcaacctctacctcccaggctcaagctatccttcacctcaacctccttagtagctgcgactataggtgtgcgccacctctcctggctgatacgtttgtattttggggaaagatgggttttgccatgttgccaaggctggtctcaaactcctgagttccagtgatctgcctgccttggcctccccaagtgctgggattacaagcatgagccacagcacctggccttcatcaaaggctttaattcactgactccctccatctgtagtttagctatgtaaaaccctgtgaaatcaaggatttcaatatgtatgtaatgacaatgtaaagccaaatgataattggaagaaactattctctgactttgttttggggtccttttgttcagcaaaggcctttagcacatgctgtctagggcccaacttctctctatttcaaactgaattcagactccataccacctaaaaatcatagactcctggagtggaaaatcagaggtaggaaataattagtgagagaaactgtattagtcaataactttctctctctctgtgactgaagtaggaaacagacctgaggcttcctttaaaccaagtatcaggtgctgagttccagcaaggaccagaaaccaggtagaaaccccaagtcagaaaataactcaaagaaggcatttatatactttctgagacagtggtatagggtgcacaagagagggagaaaagctgataatttagagggctttgattcaaagggttgcttaagagtattatgtaagcgtcaacccagctgcctaggtggcaggctgaaggtcgtttctggaaagttttacaaactttgggaatgaattcctcttgatactgataaggaacaacactccctaaagtgaatgtgcaaaaagatcacctgggatattgctaatattcactttctgatttggtgggcctgaggtaagtctagtgatgctgtcattctaataagttaacaggtgatgtcaatgctgctggtttgagtggcaggtatgtagtacccttctgctcatcacttgtagtacccaagtactcatccaggacaatgattccagggctgatataaaccatggcccaggttggcaagtttgctttcatccctcctaagtgctctgccactggggtcccatgtctgctcccatggtctgtaaatgcaaatcattttcaattatcagaaaagcaaagtggatcaccatcagcctgaaatatactcaggttaggtaaagatctcttgatagattcttgtgtccaggactgtgggttacacctataattgaggcagtgcttagcaccctttgatacctactgacaggctgaggcaaaagtgattgaaagagatggggtgaggatggaagctgcatagtaaagtcaggtactcagtattaatacctaatgagtactctgttatccacgtgtgctatttcatttaagtatcatagcagtttaatgagaaaggaactttccatttcactcccattttatggttatggaaaccaaggcctgaagagattaagaaccctgccctaatttgtgccgctggcagttgagggagcccagattctgatccataaaggctcatttgaagtctgttgttcttacctggctgcacattagaattccctgaggagctttcggaaaatatccatttctgaaccctcaagaattcctatttcactgctattttaaaaaaaccagtccaatgaatttaacatatatctgagttgagtacaatttcctaggctctgactcttaattaccagaatttataccctccagagactaagttagacattaaaacaaagaaaaaaaataggaatgcttggtggggtattttgcggaggctgaattttagagctacccaatgcaataagactaagccatcgcccactgaccactaatcttacaatagcaggacaatgtccagattctatttgctgggattctacgtgataatagctatgtataccatatgtcaggtgacacggttctaaacactttacatacactgcctcctataatctttcaaaaatacaccgaaatagatatcactaacattccccattgtacagatgagaagactgagattctgaaaggttaaatgccttgccttattacaggtggtgttaggattcaaactcaagtactttggctctagtccatgggataaacaactttgcccactgtctgtcactttatgggccacgcttgtttctcaccagctccgatgatgtagatcttcaccaccatatgtgaagtgagaacaaaaaagggctgaaagagattaattttactgaaaaatgcagtcgatattagagaatgaggctcagtgcgtaaatgtttaggaaacactaatttccatttaaaatcaggagccagtttttatctggcaaagcccttcagcaaagaaaaagttactctgggcaggaatgagtcccttcatcgctgatacgtcagatatttcctggatacctacatggcagggatgttgttgcagggggttggagatggaatggggtgggtggcctgcatgctgtctgaggtctcccttaggcatgagttgctgtgatcctgtgatctgacttaagtcctccaacactcaatcagtaagcgagggcttgatcatttacagttacacagtgagatgtttccaggaatgatttccctgtagcattttaataagtactctataaataataatttattgaagttgcctactatataagaaaaagaatatattaaagaagccgagctaattgaagctggcagttaagttccctgaatcgaaaccaatcggtttatctacatgactctaaagatttgggatgaaaattgctcattatagtctaacatcctgatacccaaagatccagttgtttcacaatatattgacatggccttccaggaaacctatgtgcaatattgagcttaaaatgttccgatacaattaaaaataaattggatcagaaagagcctttactcttctttagttgggagatgaagggatttgaaagatactgaaagctgtgcgaccccagtcagcaagattgctggttctaacttggatgaccacacagcttaagttgccagtgactgtccagtttatacctttggtcccaggataatgtttaacagggcatccattccctccccaagtatcttggtttgaacaatcattgcataatcactatgatcatcctggttaacccacagtgagagagattggagagggcacaatctaatgaggtaaaaacaggccctgaggaagaccaagcttcaggtggtaagagagaatacaaaccaagaggcagaattggggtccaaggaggagcattgtctcatgattcctcaaacatcttttattttgtgtgagtctataatttcatatagtttgttcctccctcagctcaacttttgcacgtatgtatgtgcatgtgaaaaatcaaaaacccatgatcattcttttcctctttaatgtttttttctcctgattgcattattatagggttgttgaggacaaagacagtagagtcagacatgtgaggtgcaaaaatcctctgaggattttgcattatctggcttgacagttcagagactgtctctgaactgtcaagccaggataacaactaacatttttgagccctaagtcaatcacaagtattatttttaatattcatgtaacccctatggggtacgtattaccatgatccccctttcacacttgaatgacacttgaagagattaagcaacttgtccaggattccacatggagcagatgacagcatcaagatttgaaacgagaagcctgaccaatgctccttctggccagtagtcttttcttagcagaccattatgcacagttcattggtaaatatttccttagttgcatgggggtaggagaagtgataggagatatcccctctgtcatgcagcccagtctcatgacatgaggcaagatatggaagtggtctctggagaggtgggcccactcaaggaaatcatcaaagacttctgagagaatgtattggcaggggggtggggttgtggagtggctcttaggggttggttttgtgggataggaaaatgtttacaagacagaaattagaagaggactatacctagcagtaggaatggcctgaagaatgactttggtctgaggaataaatggtgagtctaggttttcacataatccatttgggctggactgttgtaaagttcaaatgtatgaatatgacttatatggactcctaccatggcctctgctcccttcttcccatcacacaattctatcacttttgctttactctttagccacagctttttatagtacctctattcttccatgctgtttcaactcaatgacactttattagtccattttatgttgctataaaggaatacctgaggctgggtaatttactaaaaaagagatttatttggctcatgattctgcagctctagaagaagcatggcactagaatttgcttctggtgaggtcttcagggagtttccaatcacggtggaagaggaaggggagtcagcgtgtcacacagtgagagagaaggaaagagaggaggaggggtgccacactcttttaaaaagtcaagagctcatcattacctcagaggagggcaccaagccattcatgagggatccacccacattatccaaacacctcccactaggccccacctccaacactggggattatatttgaacatgagatttggaggggacaaatgtctaaactatatcagataccattaataattttccttcatactcaaatacccttttccttgatgctttcttcatctggttcattgttgttttccttctaatttgcttctcccagaaagcctactttgctattctgggcaggtgatctctaccatacagttcaatagcaccctagtatgtattcactgctgtgcacagtgcttggcactgtgtaggaactcagttagacaaaataaggccaggcacggtggttcacacctgtaattccagaactttgggaggcagaggcaggtggatcacttgaggccaggagttcgagaccagcctggccaacttggtgaaaccgtgtctctactaaaaatataagaattagctggccattgtggtgcatgcctgtaatcccagctactcaggtggctgaggaatgagaatgacttgaaccctagaggaagaggtttcagtaagctgagattgcaccactgcatccagcctgggtgacagcatgagactctgtctcaaaaaaataaaaataaaaccagctgaaaagaactggatagattagatagaagaagctttgaagcagaggtcaagttcaaagactgtttctacaatgatcctagtaagaaccagggtatgtctgtaaacatacatgagggatatgaggaagaaagattgctgagagataattctggcatgtggacaggaatttcagacaccaaaaagatgggagggccttggattccacataatctaagaaatacgccctctgtagtcctcaaacatgttttgcaagtgtttggccattttttcataagggagtttttctagtaattggaaaatctatatgaggaattgcttccagttattcagcaagtcatttgctcaacaaatgaacacatgcaatgtactgtgtactgttgacagtacagcacaaggatccagggatgactaaggctcctcccctaccatagaaaatcccagagaccagtagaggagacaagtgcttgaaacaaatgacaaaagctactgtgttaagtagtgaatctcctcttttcctcaggcccactttggcctctgacagcacagggttgatgagtcagcctcttttcatgtgaaaacatctgtctggtccccccaaagacttctctaaacattcttctgatatgaggtaattatttcatatttgctgcatttgttgtgaacactgataatctcatgaagatctattaaatgtcaacgtgttcctttctgatctacttaactagttgatgccatctttagatgtatgtattgtagtagtagttacggaagggacttgtaataaacagatgcaatgataaattcagtaaaaacatagagaatcatttatgtttctcaattataagttaaaaggcaaagccttggtaactggattttcttccatttggggaaagtgtgatgtaataatccttcatttttaagaaataaagagaaatgggtggtttgttcagttcttgatataaagaagtcaactttaaagcaacattttattagaaccataagttttgtttgaaaaaatttaaaatccagagtttattttcctttggagttgctgcagagagtcaacaggaatcgagataattttttttcttgtatttgtgctcacttattaaacacatatgtgagctagattccttgcataggtgcaaaaggatttggaagaggggggaaggtgcaatttagttcattgacctgcttccctgccctcaggagtctttcaaacagctgtgagaaagaggaagaggggaaaggagtaattttgcactcatatccagatgttcatttcaaacgcatcctgaacaacttttgcatggtttattacattttctgaaaccatttttcacaagcctgttttctcagctgggaaacttctggtgtagaattttcaaaaaaatattgcatttggcattataagaaaaaaagagcttttgagacattcaaagaacaatctgttggccttggtctgcagaagcaggacttcaggaatgtaggcattttgtaccacccaaaatataggtagacgaaagatctattcttaacatttgctttacatggaagcttgagagatcctttagcttgatgatttcaatgatgtgctatcttaggttggcctgaaatatcacagaaaagaaacctagctggggacaaacaggaccagtggaagaatccatctgaacccaaaccaaaccagaagcttccacatggcacttcaaacacagtagttcagttttgcagaactctgtactattctagtcccacccatcttctgaggtaaagtgggaaagagtggaagaaaaatagttatgaatgctaattaatttcttagaagcctataggatgcccttcccatggttggtcccatccattccccttaagatccaggacctgacaacagaggaattgaggatctagaacagcccctagtcccaccgcagagtggacttggtctcctggccaattgcaggcaatgaaactcttccttcttcatcctttctacatgtggaatcaaacctagaaatacccttaggaaggagtggatgacccagaaagatgagtccaaatggaaagactaagatctgctcttaaagaaaggaaatcaagctgcagaggtcaaggaaatcaggagaaatgataaagcaaagttttaatgtggaagaaatagaagatcaggggttttagaacccaaaccaagtcttggatacgtttcttaaccttcctgacgttcagtttgtccacttttagaattgagcacgcacctacgtctttataccagagggtgtcaaaatgagaatggagtggtgtgatgtatgaatataccatagcataccataggtcctcaatattgtttagttcttcacacctattccccaacttagagaggtagcacaataacgctagacatccgtatttctgtaaatatttctgtcgaagttctgtgtgtgtctctgagatattaaagatattatccagtaggcagttggttatactaatggtgcagtcaagagagaatctgatttgaggatagagatccaatagacacaagcacaggggtgatggccgcacacatgagcatctatgagggcacccaagagactaaagggagtgagaggtaacaaggacataaaacagagttcccaggacaccagccttggagggacaatccacataagagaaccctgcaaaaacaaaggaaaagaacactgaacaaaaacaattaaagtagaaattaataagaacaaggccaagaatgcttctaaaagaaatgagagggaggattttctaaattttaaaataaatataacccaaaatgtaaaatactgtgggaaacaataacagttgtccaagaccacatattgcactatgaaatactgggaagtgaaaaaagaagtaaaaaaataaataaataaaatgtgctaagtttctcaactaaaataggactgagtcaaaagctattgtttctttttgaccttgataattagagaaatattggatcaagtacattattttgcaaaatttagtagaaataaaaaacaggatgattcctcccaaattactgcaggagattaaagaaatcaaagcagagttcatctagctaatgacaggaaataggggaaatggtaggaaagcataaaatccagaaaacataaaataagatcatagaaggaagtgcaaatgtgtctcttatgacattaaatgtaaattataatgccaccctttaatatttaggaaccatcagttcaggttaaaaacaaagatgcacctcttcaaaggaacaatttttaaaaagtgtctcagaaagtttaaacataatatatctggaaaatatgcatcaggaaaatgtaaataagaacaacggatgtgtcagtgttaatatcacatagagtagaatcttgggttgaaaaaaaaagatacaaaacagtacaagagttcatttatttgtagttatatattctattatggataaataactatgatatagtttgctgtttttaataacagataattaaatagatatataaattaatcttttggaaattcaaaggaaaatgtttgggatatgtacacacatatgactctcaactacatagtaaatagacaaaaataaataataatagatgaagttttcttaagatgataagaatataccaaacatgtattatacctagaaaatgagtactcatctggccagctatgtttcagatttttttttcctctgtaaattgcagggaactcttcccaggagcaacctcatttgctgggagatgtggtttccataaggatatgaaactatttcagtatcctgtcctgccatatggtcacacttatctggtgacattctggactcagcacaatagatgtgccctcacatgcaagtatacagccttttctagaaaaattttaaattcattttctatgaataatgtcaagctcttgagagactcatgaattctctaggttctcattttacaagtcaactcttggaaatattagtttaatctactttactgaaaactctaggaaaactgctcttcaattctcttttctagtgaacagcattccagtcttaatccttacagactttcggaggaactccctcacatcacccacagtagaaataacatgagaaagcacacagtcatctcttgcatccatgtcctatccatgcttttgcattgctgacaagtgacgggtgggctctgacatcaggagatgcaaatggctgatgattcagacggttgtttggtaagtaaacctgggtaaaccctcaaaatgcaatgtttattttttctcctgaccacaataatctgaaaataccctcaaattgtaagaatcattataaaacagcctttttctggctcactacccacataccagaattgggataactctactgaaaacttgcctaccctgataggaatggaatatttctgacaagcttacacatgttcacctctttctagcatcaccttcattgctatcatgtctactataattatcatgcattggcagccatgaggaatattttgcatatattatataaattaatctcccaataacattcaaggcagatactatgaaaatttccacttcactgatgaataaactgcccactgccacagagtaagtacacagcatagtccttattttaaaaacttttcatcacagaaaacatcttctcctcctttctccagtgaccctctgtgtgaactcctactcaatttctagctacgtgggttccctggtcatttcagggatgtttccttctgaaatagcttccgggtttataggttctccttatctctgttcttcagtgtcttcaagtggttatataactaatgagggaactcaccccaaatgcccttgtcacatgctattgggaaacatacttaaagcagggatgtccagtgttgtccttgattacagagattgatgggaatttgtttcacaagaagttgttttcttacagtatattgttaaaagctcccagggccaggagtggcaaaaatgccatttaaatgactcgccatgcttgttttattcaaaatggctacccctttatccagaaaatcactttttttggatcaaacatcattcttcagctcccttccattctttcacttattcagtcatttatttctaacatacttattgtgtgtattctatgagtcaggacctcttctgggtgttgggtgaacaccaccacattatactaattagtgtctacactaacaaagtagacatcactgaagacctcagtgaatttggtatttagtaaggaaccaacagacaagtttaaacctgaaacagaataagatagttgctctaacagggctatgggccagataggggagagaatcatcagataggttggaaacccacccatgaggctccttggctcacgtcctgcctgcctggctgaccctccaggcattcccggacatgtctgaatattcaggatgtacacattttgggctcccattttaggaccctgttggacttggaacattgccagtctcctcttggttggcactgtggtctaaaagagggtagaaagagagtaagttctacatgtggcagaatagaggtttcatcctcatcccctttccctgcttcctggacacagtggttacttatttaccccttatcttttggagctgggatcaatgctaagctagaattagagaacagtatcactggaaaaacaaaacaaaacaaaaaaaaaaaacaggaaaaaagaaggctgcaacgctgttagaataaaatacagggaaagtatagtctaggaagaggcaagtgttagctggtaaacgattttttagtctgttgagatatgtcagcgtgagattagtgaagaaagtgcattttccttcaccaccttctcttaactattggaccagggtgacttaaatcttctaagtgccttacctggcctctagtcttcctgatgcaatagtccttagaatggaaaatggtgataacaatagctattttttaattttatgctttattaagcacttattacgctccagactatactaagcattttgcctgtattatttcattatagcctcaaaatcacactgtggagaaggtactattagcatccccattttatagggcagtggagacatagaaaagaaaagcaacttgcccaaggcccaatgtgagtaaaaggtgaaatgagaattttattccaggcacttggaatctagagctccacactccactgaacgaatgtattctgtattctcgattatctcattttacttttaaatttctggtaataaactatactatagttttatgctcctgtaaggtatcaactaaagtgttaaatagaagcaaggtatcaagattgaggccttccatcatgagacattattgaaggtgcatcttcaaaagtttttgctttggggaaaactttagtaattacagtacaagacaaataatttaaaaccccaaaagctgtggatatgtaagtgttgagctttatttcttgtatttaggatggagcttcattccagtgtgagaatttatgccttggtgcgctgaccactccataaatctaaataaagcctcacaatgttccatgtactatgacaggtgggggatgcagagaatagtgagtaggagcataaaatctggagcagaaatggctgcatctgaatcctggtactactactgggtaagactgggaaacacactttcatgttccttgctgtcaaatggaggtaagatggcacttgtagggttgtagtgaaggagaattaagaacaatgttatcttccacaattattagacatagtttaattaccaggacatagtgcctgctattaaactggacatgaatgtgaacaggtggatacccagatataggtgtgaaaagagaacagggctttgacacagccagtggccagatttaaggaaaggtgtcagagacagtggggtgtaaagctgaattctcaaagatccacaggtgtgtccctgattagcaaggcaaaaggaggcattgctggtgaagggaacagccatgaaaatggaaatggcaagagtgaggccaagcagtcagtcttagggaactgcaaattaagaactatgcctggatttaggattctaatgggggcattgttagagtttgagtctagagagaaaggaaagcatttagatctcattaaggagttcagactttatgctatgggcgataggaatccatggaaaatccttgtttcatttgtttctgttttttgttcacttcttcttcttttttttttttgacagaatctcgttcctttgcccaggctggagttcagtggtgctatcttggctcagtgcaacctctgcctcccaggttcaagtgatactcctgcctcagcctcttgagtagctaagactacaggtgcacgctaccacacctggctaatttttgtattttcagtagagatggggtttcaccatgttggccaggttgatctcgaacttctgacctcaagcgatacacctgcctcatcctcccaaagtgctgggattacaggtgtcagtcaccatgccaggcctcacttcattgttttttaacttttatttttttaaatcaaaaagagcttttgaaaatttccttccaagtagtgaaatattgtgtaaacattaacttatggacaaattgcaagtcatattttaaaattacctaaaatcccacaacccagaggaaacacgcactgacattttcctgaacatcttagaacacacatatatgattttagtgaactgattaataatattttataaaatgcttattaataatatcctatggaaacctttccatatcaataaataaaggcctatattagcattttaatgactgtagagttctctcttttatggaggtaaagcagtttatttacccgatctttactgatttgaaaaaaaaaagtttaatttctgagcagtaagcagtgcttcaataaacaactgagaacacaatgcaataaaaccataaaataatggatggaatagataatatagcaaatagtttgttgaaaattaaaaaacaaacaaacaaaactcacttctttaacctgctgttgaatgagaagagaaaagaacatggccagtaccttagtagaggtttatttattcaaaaattcagtacctcatctcttatttattgagcatcaaagatgtgcctgaccctgttctgataatggggtgcaatggtaaacaagtcagagaagatacatttcttacagcttacattttagcacagggggcagatgataaactaataaagatgcaagaacatattaggtagccatgagcactgtggagagaattaacacagggtagtacaacagactagaggatcacatttgttgggtcacctgaaaagacttctcttaggaactgctattaaggctgacaaatgaatgaccaaagaatccaggcaggtgaagatcagggaaaagtgatcttttctattcagggaagaagaagcagctactgcccaaagtgaaggatgtacttagcaggttcaagaaagagaaaaacaggggtccactagtgtagcttgcaaatattcaccaacaggaaaggtggcatgaggcacagggaaggtcagggagcatcctgtgggccaggcaggtgttcagatgtttctcttacttacaatgggaggccactagagagttttcaccagggcagcaactttatctaagattttagaagttcaattcagcctccagaaaccacagattcctaagggtaagttgctgttttgtttagctctgcattcataagacctagaaaagtacctggcacatagtagatattacttcagtgttaaaaagaatgagcagccgttaggtagggagtccaacacagaggaaatgaaagtggaagcagggattcattcattgatccaacaataattacgaaatatttaaaggcattgtactaagtattgtgggtcaatgataaatgaaacttagtccttgccctcagagagcttatattctagttggtgaaaaggacctgaactgaatacatgggtgattatttatttctattgtaagtgagaacaatatttcattccaagaaagggcatgtcttattttgatactccagactgttatctatttgctttaaattaatttaatttaatttaatttaattatttttttgagacagagcctctcactctgtcgcccaggctgcagtgcagtggtgcgctcttggctcactgtaacctccacctcctgggttcaagtgattctcccgcctcagcctcctgagtaattgggattacaggcgcttgccaccatgcccatctaatgttttatatttttagtggagatggggtttcaccatgttggccaggctggtctcaaattcctgacctcaagtgacccaccagcctcagcttcccaaagtgctgggattacaggcataagccaccatgctcaggctatttgctatttgattgaggacaggccacagctgtagcctctgtttagcttttcaaggagaaaatcaggtcttccactgaccagaacatctagaaggaaaggaatatttaggagaaaagattatcagccaagattgggatatgttggcttcttggcacctttggccccatgggtgcagatgagcagtggaagctggaccttgcagtgtggagctcaggcaagagagctggagatgggaacatagccatatgggggccaagtatagacaagggaaaatgcagtggtgtaaagtaattttcattattttccttctatggcctagttagattaattgctccttcaacagttcctacagagacctacgatagcatttaaagagcaggttctctggacttgggctgcaatggtgagcaccagagcattgtcacttacaatagaatatttatgagcaagttgcccagccccttggggtttagtctcctcatcagcagaatgtgaataacaatagcacctactctatacaattgattacattctctaatatatttacagccctgagtaatattgaagccttaataaatatctaatatctttattacattcagttgtaattattttattataaggctgtaatggcctactctagaccatcatacattgtgatcacttatgtattatcgatggcaatcatagtattttgtaaaaagtctgcttgataaatattctttgaattaatatttttaaaacacctttttggagatatgattgcacatacaaagagccgtgcatatttaatgtatgctacttgatgattctggacataagcatacattcctgaaaccattaccgcaacgtatgccatgaacatatccatcacccgcaaaagtttcttcctggagtcccaacttatctaaagtatagggaagccagggaaccccttaataactgaggatatcatgtacaagaaagggcataaaaatacgggtggcatgcactcctatcattaaagtcaggatccaatatatccttttaacaggagggttcaggtcaagttttggcagagtcaagtatcatctgtggattcagggctgggtgaatttccaatgccaagtgtttagaagtgaagctcctgcaccacctgtatcacagtcccgtgggtcagatgatgctgtctggagttcagaatcctcagtttcactcctgatttactgattcacaacttattgatagggggtgaggaagagaacagcctgcctagaactaccttaacagtggctccctgtatgtgccataaaattctaaaaatggaggaaatcaaagagatttaaaaaagcatatttgaatacttgctgatggaaattatttctggaggtcacgacataggctgggactgtgagatcctggaatcggtgtttgtcttcgtgtagcagtgtttcttttttgagaggacatgggaagtaggaagcagacaatgtctcttggtggcagtccgagttggcagggagccccttcttctgggcaaaatttctttggggcctacagagccctctttcagtcttgaacaactcacccgtgagatgggtcctgtccgctatcccgtgagagacagcctgtgattgttgttggtctgtgccagttgcagggggtataatttagttggatttcaaaagaagaatttcttttttcttttctatttttttttatgtctttctctcatatcctaatggagtttctgccaaggcaaactggtacaaaccggcgccatcaggaaagcaggagatggagcccagttctctcgaacacttcatacccaagtgtattctcactctaaatctgtatccaacacttagtcaagcttggattcctataaaagccttgtaaaaaggaagtatggatcaaagacaccttcaacatgtatcatgttgtgttcaaaacctgtgtgggagaagcaagttgtaagcactagcttctggtcagcacttcccctgagtctccccatgcagggccctgctgggggccttctaccaagacatgtcctctgagggcctctgccaccgtctcagccttatgtttccctgggaaaaagggcaggagcagccccagcagaggcccttttccctggcagcactctgtgtcagcaaagcgtctccagcaagtatttccgtgggaaggtcttccatctggagcttggcagacagaggaagtttcctttgaggttctgccaccctctcccctcagctctgcataaggtgcagcccagagaggcccagactgattttaggaagggtgcgagtgtgtttcatggagtcagaactgctgtccctcttttcctcagtaagtgggcagggcgctgagaagaagaatgttgtttgttctgccactacctcccatctcagtgtgcaacaggtcacaagatgtgacaagttcatgtgctaattccttccttttcagttaatagaataacacagatgggaacacttagcctgggatcggacacaaattggagcagccgtggaaggaagatagaggtagcctggcccattctcagcacttcattaaacagaaatgacttctaacagcattgttaccctcagctgggtatccctgagaagctactctgacaggaaggtataggcctctggcataggccctagcctcaatccactcatcccacaaaatgctcacaacatattaaaaaagtaataacactagacagcaatttcactgcttcccagagtcgctgagcagcaacgccctgacattagctctaaacctactccatagcttgtctgcaagacgataaacagaatactaaggagaataggggagaggagtgttgagacagaaatcgtagagccaagcacagacaccacggggactcctgtcatccaccttggccactgtgcatcttgaatgttcaggtatagaactggtttcaaatattttaccccttaccagattatgttctagcttttctcaaaggtgacagcaaacctttggtgatcaaatggctttggaatcaaagagacatctttaaatcccaggctgctattatgatgagctatgagtgagtacattatccagctcttcctaagactctagtttcttacctgtaaaataaattaggacaatactttcctcttatttagttgttgaggatcaaataaaatgtctagagcagtgactaagaccaaaaaatagtagctacaatgtattgatgtgtatgatatgtgccaggcattgcacctaacactttataggcatattcctaatttaactttgctaaagtgctctgaggcaatgctattataacctccccctccatgttacaaatgaggaaagagtgcagtgataagatcccacaacttgcaagttgcgggggaagggtcttgaattgaagccaggtctgtctatctgtgactttagagcctgagttcataaacacatagtaggtgctcagtaaatggtatctgtaatcattttcaacattttcaccactacattacccaaatcatgagagacctccatgccttgctaggcagtttgtgtatcagcattgtagcgttggctataagaagatggtagtaaaataggagatgatagacaacaattcctaatttggaaattgttttggaaatttaaaaagaggatgacagatgcatctcagaatttagatgaggttaggtccaaaaagtatctttgtgaatatgtgtaaattaatgcctgctttgaaccccttcctcttttttatgaaaacaggataacagcctctcctccctcttgagaacttagcctttctctattccatgtggctttgatgagaataattcacatttttcccttggcaccaggttacaagtgtgggccacctgtcatgaaccttgtctatagagatcagtacataacctgagcctatgacccaaaagggccaattgagatcattcaagaagatatcatatgttgataatagaagggttcattcagtcaactctgtctcctgtcactgtaaggctgaaataacataagttgagcttttggtagccacttctgcttctctcttttcaaataaatggaggtattttgcagtcggaaggaattcaacaaatatagggaaagccaagaaatgcagagagaagtagaggaggaagaagaggaggaggaagaggaggaaaaagaagggaaaagagaaagaaggaaaaagaaaaaagggagggtgagaaagccattattttctatctcaggatcgccttgtgtttaagatcagttctatttctagatttccatgttgtgttttcataattttacagaaaaactactagtttgcataggatacattggatttgtaagcaaagaactaataacgagcttggtaagaggagttttaatagcctcggtatgaccaaaattttgggttatcttagactttctcagtccccattcccagaacatttgactctgtctttaccagggacatctagtagcatatcccaattatgtttcaattggctctttatttcagttgcatggtgtgatggaaggagaatggtctttgaaagcagacagacataatttcaaataccagcttttccagaatgtaactctatggatcttggacaaattatttaagttctctgagtctccatttatcatctctaaattggatgtgggtacttgggtgtgagaacaggtagatgggcaaatcaaatgacttagggttaaaaaaaagtccctggcatggtgcctagcccctaaagtgtactctgaaaaatgtgtgttgtattctatccagctcaactccactctttccgtgtgaagattacatagtaattgagaataggtatgttaaatctttttgtgatccttaggacctttctgtaatacagaataatgatgttgctctgtatagcatatggccatgccatgtaaaatgttgacaaactcagcctcaacttttagaataagttgcacaaattaacaaaatatgtgaagtcttgaatttgtttgctaaaggagcaattatatttcatacataactgacacttcactactttctgtcttgtagtaacagcttctagtaactcacagctctcactgtccctattcctggggtgagggaggtgatgatatcatatattttctgatctcaggatacatctagccatgaggataccagggcaggtcccaagacactttactggtaacagttcctccttagccctgctagctttctttaaaaaaggaatcagtatgttacttttctggatttttagggaatcttatagttgaagttggttttgtgccatttttactttcatatcctctatagcagtctctctgtctctgtctctgtctctctctctctctctctctccccctcccaccactgccttgccccgattctagacaatgggaacaagattgaataagatacaatctcccaccccaaagagccagtagtccctttgatgacacagactgagagcagtttatgatctctacttctttagcttgcagccaaggaggtggagccgagacccatggctgagtgcaggactggttcctcagccctggagaggtgacattaaagggtgtctttgcctcacatggtgcccagatgcctccctttgtaccccataagctggttaagagagaattatctttctataaaagcagagagacttaatgcctggcagaccctgaatgtaaatttcaaacgatgtgatttaagtaaaacttatttaaagtgaaagttgtggtcacactgaagacacagcccatctttgttttttgccttatacaagtttatgtggaattcctttctttcccattctttatacccattgggtataggtattctcttggctgactcagaacatttatggagaaaatcagaaacagggcttcatctcttctcctaaaaatagtttctctttttcaaataaacctgctggtaaagtgtttacaagtataatatttcacacaaggaggaaaggatcatattaactgcaagagagaggaatctggcacctaattcaagaaacatccttcatacttcttgggattggaaatacaaaatccatgagcctagaaaagggagggattgagtagaacacaggaatctaaggaaaattatagcaagaaagggcttggatcaacccttatctgagtcccagtattttgaggagtgtgtttatccatgacttgccattttgaatccaaaggtagttttgtagtttttcctttttctccacctagggaaataaattgatgctcatttagcatatactatgttttgaaagaaaggaaaaagagagagagaatattaatttgtgtagcacctcatgtgagtttctacagctcaaatttccttggcaaatttattgtggagtttccacctatataaaggaattttccttactaagcatttcccagatctttttcagtctctgttttcttaatttcctaattttaaaaattgtccaccagggaccaggactgagaggacaaaatcaacagaatgaggccatgtgggatttggttgccaagactcaagagggtcttgctcttgttggagcctcaagtccaacaacggtcttggtaacaaaacacaaacagttcccttgacacttattggaagggggagagtggggtgtgggagcaattggcttgccttctaaaatgactgaaagcaaaatttgagtgaagccaattaaatccatgagtataaagtaatttttgcaagaccttcccagcagagagaagcagtcatattgaagatcaatcacagaaaaccagaagcattttgaagtggactcattaaatctaacaaggggttttgggatctgggacggaagaggacagcaaaagtcttttaaatgtaatgtttgtcctggtgagtctggaggctatgagagctcctgtccttatacacttgtgaactagttcaaaaggctaggtgaggaagcaggaccaaggctgcgccatgccctgggagagaagaggaggcagaatgtaaggaccgtggggccaaagtgggctctgttgcaggctctgaggaaggagaggcaatattcaattcagaggcatgatgaggcttgtgcaagcctggccactaaccaagagccaagatgagctgggaggagggaagtccaattgaccagcccatttgaccttgggtatgtgggaggaagacaacaggaacaccaactgctactgggtcaagtaccctctgaactgagacagcgaaaacaggaacaaggccagcagaggcttctaaagggaagcaactgaatctggaactgtgattagtcatggtatagagaacacgttcactgattcatgagcatgtattgattgcctactgcattctaggctctgttctagggacacaatgccacaagacagtcaagagggggagagacaagctaagcaacagccccaaaataatgtcataagtagcatgaaagagaagtgtagaggaaactaagaatatgcctaattagtcttattagtagagaaggcctccttcctccccattgacactaccctcatttagacggctgtcatttttcacctaaacattgcaactgttctacactgatctcttcacatcttctcatgcacctttccaacacagctgatcatgttacatgcctacctacctaaagccctttaatacatcccactacaaggcagatgcaatcaacattctttaatatgaccagcatggctctgctgtatctgtcttgtctctttctccaacttattttcctctactccgtcatgctctctgaaatgaggagatgctaaggaaaagacatccaggcaaagatgtgcagaaaagtaacaatatacaagagaaaacttagggagtagacaaaaaaaaagttctctctaaaatccactttctttcatactctgagaaggtttggtagacagaattctaagatgttcccacctcaagatttcctacccctggtatacacacacctactccaagttattaaagcaaacactaatctagctgcttctgtgaaagaattgtgcaaatggagtcaaggtcccaaatcagttgataggaaagttatcccagtgaccctgacctaatcacaggagcctgatataagcagagcgtttcatccagcatcacggaagttggagattcaaagcacaagaaagactgaaggcactgttgctggcttgaagatggagggaacacatgacaagaaatgcaggcagcctctaagagctcagaatggcccctggctgacagccagtgaggaaacaggggtttcagttcagcaaccacaaaggaatgaattttgccaacaactggtgaacttggaagaggatcccaagccccaaacaagaactccagcccctgccttgttgacaccttgatttttgctgggtgaaattctgagcagagaatttagttatgctgggcccagacttctgacttacataaactgtgagataatacacttgtatcatttttaagctggtaaatttgtagttacacagaaatagaaaactaatacttgaagcaaaagaaaattcagctttccaaaacatttaggcatataggacttaagtaagtgtcctcctcatcattgaccgatgccccattctgagatttttaatccagacagttgcccaaagcatgaagaggggatgtatatcacgtgtgtctttagaaacagggcagggagtagttctactcttaactgcaactcacagttgaaagtccgatttcttgtaatattgatatctgtgttctttctggaatggaaggggtcgcagatatttagattatttttgtgaccaactaagagtgggtaaaaggtgaaaatgggctgaaagctggtattagagacatgggtactacttacctgtagaataagcaaataactgccttaataagtaaacaaataacttctaagtttaatccccaaaccacaattctataagttggcatacaccaaagtattgaaagttgatttggaagtattgacatagaccaaagcccaaagtgcttgtagaatttgaggggagaaccagagtggcatctcttggcagatagcatggaagggagacctacattccccattagaaaggaactgggctaatgttgacatctgacctgtagcaatgttctcctaatacacgtagcccaagaaaagaaagctctttgtcaactgagagttgctggccacttgcctaatcaccagccttgcttgctttagagaaatttattaccataaaaaagggacaaactgtaaaactcagacttcagtgttgaaaaattgttaggcctttggcccttttctcagcatttgcaaagaatttccttatatacttagtgatggggttagatatatgtaccttggagaggagcacttgtattggagcttttccttttaatttttcttccacttttaatttaggttcaggaggtatatgtgcaggtttgttacatgggtaaattgtgtgctgctgaggcttggtgtatgaatgatcctatcaccaaggtagtgagcataaccttccaactcattccccactttcattttcccccgtcaagcagtctccagtgttcccatctttgggtccctgtgtattcaatgtttagctcccacttataagtgagaaagtgccacatttggttttctttctttcacagcaccattcacaataacaaagacatggatggaattaacccagatgcccatcaatgatggactggataaagaaaatgtggtacatgtacaccatggagatttttcaaaagggaaactgtgttagaactgagccgcctcctagtctttccgaagaatgtatcaagagaacttttgttggtgtcagaaaaggcatgttggtgtcagaaaaggcttcccatgaaggcaatattggggctgggaaaaatgttcatatgtcagacaagagaaagctaggacaatctagtcagaggttgcagaaggtgtaaagatggtggcatgaatgaccgtggaggatccaaaaaactgaaagtcagtttagtatgcttggagtacattatttagtcaatggcagaaagagaagatatacaattggagatgaacttggaaaagtaggtctgactcagagtcaaggtaaccttgatgctttcctgagcaggctgggcattagcctgtaaggaccaaaggatttttgccaatggcatgatgtgattattctcattttggaatgctgtccatgagggtagcagtgtgaagaataaattgagatatctaggatgagatcccatttctggtttggccaatgtcttgaaatgagataaggaattaaattgggagtcgggggggatatatttagtttgcttttggacatgttaaattgtgtttgcctgcattacacaagtgaatatgttgtgtttctgttactcaggacatggtcaataattggaaattcagactggagagctgtcacacttagcaggggcagattcatgagcttgcctagggaagcaggtagcatgattgtttattttttctgtaaatcaggatactcctttagtttattttacatagatcaatcactcttgaatttttgttagggaaggcactcacttatcaatcatcaaaaatttaatgtgatccttccataattggcactgttcagacatcaatggtgttgtagaagacaagatggaaaaaatccctagcctcatagagcttcactccacaaaaagatgaggaagagtaacaaatcatagaataaacaaatgtcagatagtggtaagtgctatatagagaaataaaacaggttaagcagatcaaacattgctatggagataatcgttctattttagatagtttggccctgtaaattgtccctcaggacatgacatttgagcaaagatctgcatgaggcaaggtatgagccagtcaaggtctaaaggaagagaaagcggagtctgaaaggtatgagtcaggaatcagacattcaaggaaatgaaagaaggttaagggcagacagagatatgtgaatgaaaggcagagaagtaggagatgagaatcaggcagacgactgatcataacagaacttggggctagggttagtgagtttgggtgagacagaaaccactgaagggctccaaacaaagcagtgatgtcatctaatgtttatttgaaacaattttattggtatccatggttaatagggagtgtgctaaaagattaaaattattattattactatttacctgttcagtcacccactcatataatctagaaacatattctgaaagcctgctctatgccaaggattgtgatagacattggggacacaaaaactagtaagaggcagtcctttccttcaacattttgcagtattacaactaagtatgcatacatcacacttgacaatggagattcttgcacccacttcccattccatgccgtttaccctatacaccggaggtagaattatttaaacaccaagtagcctggcatatttttagcatcttaggaagaccctcactggatttatatattttattatgtagttattcccacttctcactctcactctccttctaatattcttcatgtatctagtttcatttttataacttctttcaaaatgtgtgttctagttttgcagtgacttttatttctttcaaaatatatgtttcagaccagcagtagagagtgtatgtaattcattagattgtatatgggggccaagagtctacattttaggggaaaaaaaggtccctgggtattgttgatacctaccccagctcggaacttttcaaagcgggaggtactaaagttcattgatgtgtttgtaaacttactcctttgggggaaaaacactctgatttgtagcatttgctgattttcatggtgcgaatatttccaccatgaccaatcttaagctaagaaagatttaacaaccaggctgcaaaaatcctgaatagtgagcaattggctggagccaatttcagcatactgttgttatgtcttcaatcccacctacataagtacctaatgaagacattactctgctcgtaagaataggtcatcttagtacaatgtgtcctaaacaggtaacaggaactttcagtgtacctagataaagtcaggtaggtgttgcagaatccctgataagcccgtctaaaattgagtgacagagctccttttctttcaaggatagtttttaaagtttgttactgggtttctcatgtgcaccatgatagaagccaactgttttgtccttacactctgaacaattcctagacaaattagaaggatgcctcatggccattctattgcctcagaaatgtttgccatccttgggttacattgtttactggagccaggatctgcaggtgagaactgaagagtacagttgggaggacaatggatcttgagaatttagaagatatttggattttagaaagtcttggaagagaggagctgaatcatttctagaagattcaaaggttgcttcttttgagtagtgcaatttccatatgggcttgtgatatcttaaaaatataggtagtcttcctcctttaagactataaatggttaaatgcagttactgagaagtaggcatcatcatcatcatcacagtctaaacatcttacatatttaattgtgaggattacaatagagaatcttgtaatcatcataataacctgataagtttgtcttagtattttctccatattataaattaggaaatcagactcagagaagttaaggaacggatccaaaaccatgcaagatggcaaaatgtagctggggtttgaaaccagactacctgtgcccagagctctcattttccctgctctgtcatactccttcccaatggtcttcatggtgcctgatccatagtgggtgctcccaatatatttatgcaatgaataaaaataaataaatgacagtgtgacttctaagagaaataattaagcttggaatatatagatttttagagtttttaatgtaatgaaaggtcatgtatataaagccacagcaaaatgttctgctatgaaccttgaaaattgagttcttccttggaaataaaaaaaaaaagtgtgagcttaaggtaattgtccttttatactgttgtacttgtcatagtgccagcatctacacttttcctctagagataaaattaaaatgccaaattttcatgattatgagatgattacagaataagtgctgatggaagaatcatgaaacagaaaggagagtctgtatgccttcccaactagttaaggacttttttttttttttttactttgctttgctttcctttctttttttttccctgcaagagatatactacataaggattttcttccatgttcccactgtatggactctttttctctcgattattattcaccctctgattggttgtgacatgtgtctttagacaggaacacttgtgaatgctccagcaccattcaaaaggtagttcatcccagctggactgaaaacactaggaaagtttcacattgaaggactgttgcttttgttgtaataaagaatacatacttttcctactaccaataactcttcccgtgattagaaaggattcttcacaagaaaactttggccaatgtgaaaaatgaggtttccattacatatgtcaatgtaattgtcatgtgaagtttaactgtcccgcttgtttatttgctcattacatctaaagggaaagcaatattgtgggggggacaatcaggtcctgagtgcatcagtttaatccagagagcttatttttgatttaaaataaaaagcttcagaaagagaactgcagacgtagaatccatcctttgctcttttgtttcacatttcagtgggatgcagacagacctgtgaggcatgttgcaaaacaccagcaagagatccaaggctcactcctgaggctgactctgattagacccttgctaaccacagttcaagtagatgaaaagggtgagtgtattctgatggaattctcctttggttttccctctggggctgatgggaggggacaagtccatttgtcctgttttacaagtgcgatgtcttttgctcttaaaaaggaagagcttgccacatgccatataccccactattagtcaagcagtggaaagaactcaatacagactaaaaagtacaatgcccaaagggacaccatcaatcctttattaccacaacttcctcattcttgagttgtttatattgatttatcttttgctcaggtagagtgacttagagtaattttctcagcaagagaacagggatggcctctgttctgagcctttgccagcctgagaaatatttccctctgccctcatacagaataattgggcatggaattttcgggccataatcttttcctctcaaactctgtagtttttgttactaattttgatcttagccaaaaggtgaagaagcaatgaattttctgtttgttttttttttttcagacgtgtgtggcatatagcaatatatgaagctaagattatttggaatgtattttagtcaacctaacttttattcccacttctatttaaagtgtttaggctttatatttgaagtgtcaccatattacttgaataaatctcaggttgtaattctgtgtttttttttaaattaattttgcccaggatcaataaattcttttagttcgcagattttttttcttttactcaataatgtttccttctattactcctttaattgcttctggtgtgtgttttttaccaaaagagaggtttctctgagacacgtcttttatgtgtctgtgtgtatagatagatagatagatacatagatagatatttttacatataaatgtgtgtttatatacaaatatatacaataaaaatatttattgtatacttagtatataaagtatgtatatatctcacacaatgcaaacgcacacacaagtatatatatattctattatgtatatatggtccatattcccctaggctcatcattatttgtttttttctaagtttcaaagtttttttcctttatctttaaacgcttctgaattcctataatcttttttcttctgatacacatagttgtttgcataaaatctgtcatttaccacttttacgatctgtcatttaccacttttacgatgagtccttaattcaaaaattgaagcaataatgtatcctttaatttcttcccttatctatctttcctgattttagattgtttcacttactgtatgcttacttaatttcacaaattctatgtgtcttctagaagtttaatcagaaatgttctcaactttctatatttaagagtttttctctgattcctgggaactggtaaaatgtagaggtttgctcttgagcccatttgatgagcctgtttctcaagcatggattgctttcacaggagattggaagagaaattttacccagtccctttgttctctcttcttcttctctctggttcttggttctgctattggttcttctctcagtactgtctcttcatacttgtacaattcctgagtttttatataaccactaaaaagttgttggcatagaaaagacaaagacccaaccactcctctgaggggttttttggttgttgtttattttctagatggaaatgtaattttgggcttgcttcaaatgaatgtagtaaccagaagaagccctgtgttctagagagtgaactccagaaacaattttccagaaaacacatattttctataataaagtattaaacagcaaagcgttcaagataccaagtatgtttatttgtcactatggacgtaaattctgtctcattaaatgataaagttcccttcttttgagatgtgccctttggcccatgccactgtggctgctagtgtataatgcaagaattagattatcagcacccattggcatgtctcagttttgtcttatgttgatccacgtcatgtaagtatatgtgtaatacatagaaatagcaaggtagaacttagttttaattactgtatgacttatattagtatttgcctcatgctttttatttaactaatgactcacagatgctccttttcatgttatttgaattttagaaatttatctatgctatctttcacttctaagtgcaatcatctgcttgtgtcatgcctcttgccatgttccactcagtagatgtcaaaaattagtctcttgcttctctagttattttaattgtgatgttagggtgtcaattttagatctttcctgctttctcctgtgggcatttagtgctataaatttctctctacacactgctttgaatgtgtcctagagattctggtatgttgtgtctttgttctcattggtttcaaagaacatctttatttctgccttcattttgttatgtacccagtagtcattcaggagcaggttgttcggtttccatgtaattgagcagttttgagtgagtttcttaatcctgagttctagtttgattgcactgtggtctgagagacagttcgttataatttctgttcttttacatttgctgaggagtgctttacttccaactatgtggtcaattttggaataggtgtggtgtggtgctgaaaagaatgtaaattctgttgatttggggtggagagttctgtagatgtctattaggtccacttggtgcagagctgagttcagttcctggatatccttgttaactttctgtctaatgttgacagtggggtgttaaagtctcccattattattgtgtgggagtctaagtcactttgtaggtcactaaggacttgctttatgaatctgggtgctcctgtattgggtgcatatatatttaggatagttagttcttcttgttgaattgatcccttcaccattatgtaatggccttctttgtctcttttgatctttgttggtttaaagtctgttttatccgagactaggattgcaacccctgcctttttttgttttccatttgcttggtagaccttcttccatccctttattttgagcctatgtgtgtctctgcacatgagatgggtttcctgaatacagcgcactgatgggcttgactctttatccaatttgccagtctgtgccttttaattggagcatttagcccatttaatttaaggttagtattgttatgtgtgaatttgatcctgtcattatgatgttagctggttattttgctggttagttgatgcagtttcttcctagccttgatggtctttacaatttggcaagagcaaacacattcaaaagctagcagaaggcaagaaataactgagatcagagcagaactgaaggaaatagagacataaaaaacccttcgaaaaatcaatgaatccaggagactggttttttgaaaagatcaacaaaattgacagaccgctagcaagactaataaagaaaagagagaagaatcaaatgacgcaataaaaaatgataaaagtgatatcaccactgatcccacagaaatacaaactaccatcagagaatactataaacacctctacgcaaataaactagaaaatctagaagaaatggataaattcctcaacacatacactctcccaagactaaaccaggaagaagttgaatctctgaatagaccaacaacaggctttgaaattgaggcaataactaatagcttaccaaccaaaaaaagtccaggaccagatggattcacagccgaatcctaccagaggtacaaggagaagctggtgccattccttctgaaactattccaatcaatagaaaaagagggaatcctccctaactcattttatgaggccagcatcatcctgataccaaagcctggcagagacacaacaaaaaaagagaattttagaccaagatacttgatgaacatcgatgcaaaattcctcaataaaatactggcaaaactgaatccagcaacacatcaaaaagcttatccaccatgatcaagtgggcttcatccctgggatgcaaggctggttcaacatacgaaaatcaataaacataatccagcatataaatagaaccaaagacaaaaaccacatgattatttcaatagatgcagaaaaggcctttgaaaaaattcaacaacgcttcatgctaaaaactctcaataaattaggtattgatgagacgtatctcaaaataataagagctatctatgacaaacccacagccaatatcatactgaatggacaaaaactggaagcattccctttgaaaactggcacaagacagggatgccctctctcactactcctattcaacatagtgttggaagttctggccagggcaatcaggctggagaaggaaataaagggcattcaattaggaaaagaggaagtcaaattgtccctctttgcagacgacatgattgtatatctagaaaaccccattgtctcagcccaaagtctccttaagctgataagcaacttcagcaaagtctcaggatacaaaatcaacgtgcaaaaatcacaagcattcttatacaccaataacagacaaacagagagccaaatcatgaatgaactcccattcacaattgcttcaaagagaataaaatacctaggaatccaatgtacaagggatgtggaggacctcttcaaggagaactacaaactactgctcagtgaaataaaagaggatacaaacaaatggaagaacattccatgctcatgggtaggaagaatcaatatcgtgaaaatggccatactgcccaaggtaatttacagattcaatgccatccccatcaagctacaaatgactttcttcacaaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtacaaaaacagagatatagaccaatggaacaggacagagtcctcagaaataatgccgcatatctacaactatctgatctttgacaaacctgacaaaaacaagaaatggggaaaggatttcctatttaataaatggcgctgggaaaactggctagccatatgtagaaagctgaaactggatcccttccttacaccgtatacaaaaattaattcaagatggattaaagacttacatgttagacctaaaaccataaaaaccctagaagaaaacctaggcaataccattcaggacataggcatgggcaagctcttcacgtctaaaacaccaaaagcaatggcaacaaaagccaaaattgacaaatcggatctaattaaactaaagagtttctgcacaacaaaagaaaccaccgagtgaacaggcaacctacagaatgggagaaaatttttgcaacctactcatctgacaaagggctaatatccagaatctacaatgaactcaaacaaatttacaagaaaaaaaaaaacaaccccatcaaaaagtaggcgaaggatatgaacagacacttctcaaaagaagacatttatgcagccaaaaagcacatgaaaaaatgctcatcatcactggccatcagagaaatgctaatcaaaaccacaatgagataccacctcacaccagttagaatggcgaccattaaaaagtcaggaaacaacaggtgctggagaggatgtggagaaataggaacacttttacactgttggtgagactgtaaactagttcaaccattgtggaagttggtgtggtgattcctcagggatctagaactagaaataccatttgacccagccatcccattactgggtatatacccaaaggactataaatcatgctgctataaagacacatgcacacgtatgtttattgcgccattattcacaatagcaaagacttggaaccaatccaaatgtccaacaatgatagactggattaagaaaatgtggcacatatacaccatggaatactatgcagccataaaaattgatgagttcatgtcctttgcagggacatggatgaagctggaaaccatcattctcagcaaactatcgcaaggacaaaaaaccaaacaccgcatgttctcactcataggtgggaattgaacaatgagaacacatggaaacaggaaggggaagatcacacaccggggactgttgtggggtggcaggagtggggagggatagcattaggagatatacctaatgactaggtaattaactagataatgactaattaactaggtaattaactacataatgactagttaatgggtgcagcacaccaacatggcacatgtatacatatgtaacaaacctgcatgttgtgcacatgtaccctgaaacttaaagtataataataataaaaaaaaggaaaaaaaattaggctcacaatcaacaagctgtattgtacttttaaatacattttataatcataaacatgtattttttttctgagcacctacttggtgaaaagttttagaatttaattactctgtcatccaaccaaggaagctttcaataaaaatatagacactcaaggagaagttaggcatcaccatgcttcttctttctggggaaacaagatgttatttggtcaaagatttttaaattgaccctaagcttcttcaataatttgtaaatacccagttgcaaagagaatgtataaatgtctatctaactctgagaagcttggtgtcatagggaaaatgctagtttctctcttgctgcattctaaggcagagcgcactgatggccaaagggaatctggctgtagcccaaacccatttctctaacttccaaaccagagaggacacactctgcttccaatagcccatccaacaatgatggaaccatggctgatgggaattatctcaaactcatcaggaatgaacacacacttgctaatgactaacttccttcccctccatgtgtccctgcagaggaagtaggcaagagagagcaagacccttggctcaacttcagccttttcccctttttcctttcccaaataccctctcctctcactccattagcattcttgattcttgaattcccatcaagttttcaggggaaggggaaatactatttcttgcactttttgttggcgaagaaactgatgctgtctgcctttcattgttctacccagcatccggtttggacttgactgagggcagtgatgaaggtgaacatccagttgtgtcccatgtcctttgaacaactgtctttacacagacaaaccattttggagactgtttatgcttacttgaagtatcagtagcaaactcactgcattacccccagtgagggccactgatggcattcaaaaagctgcaaaaacaaaaacaaaaatcaaactcataactaaaaaacccacaatgtcctcaatatattgattaaactttctgtatgactatagacatggaggagaagaaatcaacagagagagagaaataggctctagaaataggctctgctttcccaacagcaacaatggttgtgccttatcatgtgaataacaacatactagagttgaaccatcatactattggtatatagtaggtgatcaataaaatagttgtgaatatcagtaccatatttgcagtatacttgcctttctaggtaactggatctaaaggataaataaagtacatctaacttagaactgaggagaggtaaattgtactctttaggttatggaaatatttttaaataaactctttcttttggaattatctttgacttacaaaataattagctgagtacagagagttccatatatttctaactcagtttcccctaacgttaccagcatatattagcacggtttatttgtcaaaactaagaaaccaacattggtactttactataattctagattttatttaactttattttaatttcactagttttcccatttttttgttttgttttgggatcaaatccaggctaccacactgcattttgtcaccatctctccatagacaactctggttagtgacagttatttagtcttactttgtttttcataatcttgaccattttgaggaataatggtaagatgttttatagaatacccctcaatttgggtttgtttgattttccttatggtttgactggggttttgaatttttggatagacgaccacaaagttacatgatatccacatgatatcactgatgatgttaacctttatcacttggttaaggtactgtctgccaggtttctccactgtacagttattatttttttccttttatggaatagcttctagtttggatatattataatttcatttagcaagtctttttatatagatcaggaaatggttctttattgtgaagttaaaaagaaaaacaaaaaagaaagaaatgtcttgctggaatcctggagaaagtttggtcagtacttgattttggtatcaaaatcacccaatccttgtggaatttgaaagaggttaagattgtagctgagagtctaagccatgcaacttctctctaagctcttatcatgagcacagggtctgcacaccatcttccatgggcactgaagttaacagagaaatccttccacccccacccagaccttttccatgttcttctctttaccatttctcatcgtctctctctaaccttccattgtgccctctgacaggcaaggccccatctccccatgttgtgtcctccttcacggatcgtcagttacttctgtgtctagttcctaaccttcataaaggacagaagtgggcgggggttatcagatgctgagactgtgggagagagaggaaggtggccctctttttggcctgctctctggatgaagtatctacaatacaactagacctttcacaatgtggaaattacaacttctgctagcatatctcctaatttcacgatgtttgaagaggatttgcctccttatccatcttgaattactatgtaattctatttctattaatgcagtattgataaaccactttccaaaactggaggacagaggtcataggggttaaaatgaatccttccattttacataggtcttgggttaaatatcattggaaaaatatatttatttatttttagtttttgagatggactctcactctgtcacccagactggagttcagtggcacaatcccgactcactgcaacctctgcctcctgagttcaagccatcctcccacctcagcctcctgagcaactggaattacaggcgtgcaccaccactcccagctaatttttgtatttttagtagagacggggttttaccatgttggacaggctggtctcaaactcctgacctcaagggatacaccagccttggcctcccaaagtgctgggattacaggagtgagccaccacacctggccaaagtatcttaattttatttttaagaaaaatccaggaatagcaggagttcaggtttctgcttaagctgtgttgtcttctgtggttcagatatatctgtgtctgtctgtcccactgtgtgggtgactccttcagggttttccttgtatgaggggtcagttttcatcatagtcttggggaagggggaccttagttcaaagaggagaacttctactctcaaggagataaaatttggaaaaaataacttcagcagttagtgattttgcagtttcagtaatcaatacataaattattaaaaagtataaacttgccaacgtttgaattgatgatttaaaagataaagttgatgaaatgtgtcataaaagaaagtagaaacacatagttatagattcaaaaggaaagataagagttttgaagacagtgccaggagattagactcattgaattaacaggaagaaaaaaggaaagatgaaggaaaagtaatatttcaaaaagaactataagacaatgtttttgagcagcagaaagataaatatacagttttgggtttcttgctaggtatcaaaaaattactgggaaaaaatgtgaacttttgaaattccaaaatcctaagttacatacaaatgcttaaagcttccagttataaaaaactgttcacatatcagagttaacctgtttagcctcagatttgcctccaatacatggacgctattccgcaacatgtatagacttttgagaggaaaggcctgcaatgtcaaattctacacatgcataaaatattatacacctattgctgaaacaaccataaggtgagaatagtctcagtgaatacaatccatgtttattatttggaaaaatatctgtgaactctaaataaatttcagtgcaataagactagaaacctcaatatattggaagatataaaaggggaaataacaacaatgaataaaagatggataaaacaatagatggacacaatttctatgcttatatacatatcatatataattgaatgatgataatgttactgtgaacttataagcacacagtgagtctttttggaagaggaaacgtgtagcaagagaaatcctttcaatagactgccccccacaaagaaaacaaaaactaacaaaaaaacccctactttttcaacaaaattaagtggcagatgtgggagaagggggggaataataaagaacaaaaaaattaacatataataatatgccaccacaatgacatacgtgagatccaaataattaaattgttaaatataggttcatgtgttattaatttattaaaacatataatacattatttttaggagatctgtacggtctaaaatcacaaaagatagtgtaaagtatacaaaagtacacaactgaaagatacttgaactgaaaagtcccaaaggatcacaaggtggtcaaatcctaaccacagcccacttcttataaagaataagagctttaacctaaccctgtttgagaactggagctgggcagaggtgaggagccatttactaattgcattttctccaaattcaggtttgacaggggttactgcaacttctaagatctcatattgaggtaaaaagtgaaggtattctaaacatttatttcagtgggacgggggagtggatatgtaaagtgtcagtgggaaaaatacaggtttaattgtgacagttaagaagtggaagttactactagactaaaaatgcaatagagcttctaaattaccaggagattaccaacagtgaatgaagaaaaatttcattattgtttattattagacaaaaatctaatgatgcattggacaatattaacatcagaacaaagggaaatcaaggtcatcggaactaaacaagatagagaggaatattatgtaataataaaatttaacagtccataagagacttacaaatgatgtacatctttacatagccaataacactgcagaaaaatgtaagaattgagttagacgtcgaaagctatggtaacttgttaaaataaaatttcattggaaaatttcagtgcaactatttcagaatataaaatcaatgaggacacaaatagaatatttaaataatataatcaataaacacaatttaatagatttgtatgcaatgtactatcttaaaatatgaatatacatccttttaatgtccttggaacactataaaacaacactaatacacttagatacaaaaaattttaatatctatccaaagagatattttataggcctcacttttgatcatagctttctctcccccaagattaaaatcaataacaaataaagtctatgcctgaaaaacataactagctcatttctatttaaaaatgtttttctaacaatacgtgattaaagaggtgaaaatataagtcacaaattatatttaaaggatgaatgggaaaaataaaccctcataaaaaaaaccaatgggtcacagtcaaagctatctattttcacaggaaaaaaataaatttccagaagaaatattttcagggttaattaatatattttctgaggaaaatatgtagcctgaaccgcatttaaaaaattattgttaaaagaggaagccttaaaatagattaaaaaaaaaacaacccttgatttcaagtatacaaggtgtaagaaacaatgaacagtttacaaaaagagttacctaaagtcaaagtaaaatgttaggaaatgatttgtgatggggaaaaatggatgaagtggtcaggaaagccctttctaaagaactaacattcacagaaaattaaaggaactgagaacataagtcaagtgaaaatctagctatttatgggacttctctttgtggtacctgggattacttatttttggttcatattgaggtagccaagaaggcttaggtaggtaactagaagaaacaaaatcatttcctttcttcattgttttataacagtgaacctatctttacagcttcttatgattatgtagttagtatatttgtattataaaaatcaagaggaaatattaaaaaataaatgtaattgtcccttgaaattctgctgtatgaagaaaaccaaaatcaatgttacagatcatctgttcatgcacctcttcatgtatgtgtatatatgtatatacaaatattattttgtttcttatggtacatattttaatgccatgttttatttttttcaatgtttgatatttatcttctgctttccctcttctgcctcagataactaagattggccacatactgctactctttcatatcttattcaatgcccaaatgatcaagtcactgtgactgtagctttaactgttgacacagatttagatgataacatggatatagacagcaaaattgtcatcattattttgttttaaaaaatgatcacaatcatagtgcttctttacatcttgtttttctcctttcctcatagactgtggcaatctttccaagtaatttggtctgaaccaaatgtagtctgttagtagtaaataataatccctgatatgaatggaccataatctatccaatctgtatatttctgaatagtattcacttttccattctagtttttgttactgtcaaaaatcctgcaataaatatttccatgtatgtatttttatattttgctatttttatttatataaatttggctctgaggagtgagatcaatgagttgaagaatatgtatatttttaacttttaatgatcctttcaaattgctttccaaaaaaggttcattactaactcacatggacagcaacaatgtctgagctccatgctatctacatccttatcagcaaccatttttttctcatctgataagtatgaaagactaccttgacattatttttatttgcatttttccaacaaaaaggttgcatgcctattcttttgcttccgttggtcttttatgtttgtaattgtaggagctctctaatcatacatttttcccattttttcctggtggtgtgtatgtgtttttcttgtcaatttgttatcaataatattattgataatagtattgtaatgtaaaaatgttattattaataacaatatattattgataatagttatcaataatattattttaaatatattgtgacctttaatctagtatgtgtagcatgtatcctgtgtttcagtattgattttaaaaatatttaaataaacaaaagtttaattttcatatattcaagtatctctgctttttccattacacttttgggtttattgttttggttataaagatttcaccaccctttggctttaacatttctcctgacatgttacatagttataatttttaaaaatatttatgtttttattacagttatggtatttttaaatatgacatgaagtagatatctaactatctctgtttttgatagaaaaccagttgtgctggcatcacttattaaatttccactaaattgaaataccatttatttaatttatttagttgtcatatatattttagaatcagattctgggcactgtattctgtttctctggtctgttttattttttatgctaatacaaactgttttcattacagagacattatcatatcttttattatttggccaagcaagctcttccaattcttcagaacctgaagctgaacataagtgttgccctcattctaattttacatattttgcttttccagtgggattgtatggtacccaacctttctgtaagatcatttttgcttaaaaacctcaagtggtttatgcattcctagctgaactctgagggatgcagagtatatcaaggcagctaaatattttattaatatatacatctagctgggcagagatatttagaataattaattttcaagaatatcatttttaatagcaacaaggaatataaaatgtctaagaataaatttaacaaaacatgttgaagacatttatggcagattttcataaaaatacataataaaaacatttgatatattaaaattgaaattgactgcataattaacagcatgaaaataaatgacaagccacagactggacaaggaacttggccaatcgaataacctacaatgttttagtacctaaaatatataaagcattcttgcaaatccaaaattaaaaatgcaaataaactagtagaaaagtggcaaaagccaataaggacataaaaagatcataaatttcgcaatgaataaaggatgtgcaaattaaaaccacagtgaggtatctttttatccatcatatttgaatattttattttttaattcacagtatcatgttagtgagcaaatgcaactaaaggggctttaagggtctatttattgataacagtaatagagatatgcaccatgaaattatagaaatcctaaatttgtattcatctaataatatgacctcaaaatatatgggcaaaagttgacattactaaatggagatatgggcaaattgataatcatagttgtaaattttaatacacttttctcagtaactaatgattcaagcagacaaaaataacactaaggacatagaaagttgaacaccagatgaaccaacctgaactaacagtcatttgtagaacactacctgtagcaactacaaaaaggcattcttatcaactgcacatataatatttaacaaaacagaccatattcttgcctataaagtaagtcttaacaaatttcaaaggactaaaatcatagagcatatcctctgtcaacagtggaataaagttagagaccaataacagaaaggtcactagaaaatctccgaatattttgaaactaagcaacacatctctagatagtccttgggccaagaaataaattacaattaaaattataaaatattttaaagtaaactccaaaataatatatcaaaaccataggatacattcataacagtcctcatagagaaaattattcttcaaaatgcatatattaaaaaagaaaaaaaggttaacaataaaaaatctcagttttaccatagagtatttagggaaaatacatagcaaattaaacccacagaaagtaaaaaactaaaagaagatataaatgaaagagtaaatgatatggtttggttgtgtccccacccaaatctcatcttgaactgaagttctcataattcccatgtatcgtgggagggacatgatgggaggtaatttaatcataaaggcagttaccctcatgcttttcttatgatagtgagtgagtcctcacaagatctgatggttttataagggcctttccccccttttgctcagaacttctccttgctgccgccatgtgaaggagaacgtgtttgcttccccttccaccgtgattgtaagtttcctgaggcctccccagctatgcctaactgtgagtcaattaaacctcttttcttaataaattacccagtcttgggtatgtctttattagcagcatgaaaacagactaatacagtaagcaaatgaacaagataaaaaatgagaaaagctttttgttacagtgtgaagaaacaaaatatcaacatcaagattcctacagatccagtcatcagaagaatcataacacgatattagaaaccagcatatgccaataaatttgcaagtttaaaagaaatgaaaaaaaattttgaaaaaaaggaactatcaataatgacacaggacaaaaaattagcaaattgacataaccctatatccattaaaataagctgaatctataatttaaaacttttccttaaaaaatctccatgtccagatgacttcactaggcattttttttcaaaactgttcaaagaagaaataatattaacacacaacatatacaacatgcaacaacaacagagaacagaaaaacaatattaccaagccactcaatttagaaaataacaataacattgataccaaaacttgtaaagaatattacaaaaataaaagaaataaggatcaacattgttcatgaatatagatgtaaaaatctaaacaagatgatagcatatgaatttaatgccaaacgagaaaaagaaggatactaactcacctttttagatataattagcttatttaaaaagagggagatggagattatttatgatagaagagttcagaacttcagtgaaatgggcatcttcatgttgataccacttcagtagtgatttatttctgtctacattccttccaagaatgtcaccatctctaaataagaataatccttgtcatctataactactttgttgcctccatattctgggagacaaattttatctccaaatttcagactaattggttgtatctctccacgctttcctttacagccagacgtaactaccactactgttgcttgcaatacttatccttgagattttttgggaagcataatacctcctttggttacagttttgactgcgatactttcaaccaatactcagtcagaaagcaaaaaaattaaaaaaaaaagttctaaatgtttgtcctgccatgactcctgttgttcttgtgctgctgttgcatggaaagcctaattcaatttgctgagaggtaccttggaaaaaagtctacggttagtggtaaaatattaatggtttacttctgagataataaacaaaataagaatatccatcatcatcacttcaactcaacattgcatgttctagccagtggaatgaagcaagtaaaataaataaatctgggaacgttgggaaaaaaatcatgattattcatagaaaacatgtctgtatatatagaaaaatgaaagactcaaaaaattaatggaagtaaggagtgaatttagcaagttcactggatatagggtccatatacaaaataaattttgttttcataagctagaacatgcaagtagaatattaaattttaaaagtattatttcaatagcaccaaattcagacatattgctgtctaaatctaacaaaagacatatgcaagatctctactttgaaaactatacaacattgttcaatgaacctagaaaagacctatgctcttaaattgaagggcttaatattgttaagatgtcaattctcttcaaattggtctatatgctcaatgcgctcaataaaaagtccagtttttttggaaattgacaaagtgattttagtgcatctatgtctgtgtgtgtgtgtacacacacacactggactaaggcaatcttaaataagaaaaataaagttggatgaccatatatcaagatttaacataaagtttcagaaatgaatatactctgctcttagcaaaggataaacgtattagtccactctcacactgctatgaagaaatatccaagactgggtaatttataaagaaaagatgtttaattgactcagttccacctggctggggaggactcaggaaacttacaatcatggcagaagtcacctcttcacagggcagcaggagagcagaatgagtgcaagcaggcaaaatgccagacacttataaaaccatcagatctcgtgagaatttactatcacaagaacagcatgggggaatccacccccatgatccaatcacttcccaccctggtccctcccatgacacgtggggactatgggaactacaattcaagatgagatttgggtggggacatagccaaaacatatcaataaatacatagaaaaataaatagaagatccagacccccccaaccaatacctcgcagaatccacacatttatggtctccccagcaatgaaaaaacaaagtatcattttagtggggaaagtacaatcattttaataaatatgcaggatctatgctatatctctttggaacaatgagaattgacccttacctcccacatttaatttgagatgaatcatagaatccaatgttcagggaaaaacaatgcagattctacaagaaaataccttcagaaatgtagagtaggccagagtttttcaatctcatcactattgatacctgagaccagataattgtttgttatgggagttatcctatgcactgtgggatgtttagcagcaaccctctattgactagatgccaccagcatccagtagctaaaattaaaaaggctgacaataatacatttcaaggatgtagaacaactgggtttcataattactctttgggagcaatgaaaaactcttgagaagtacctgttaaagctacatattacttgtaatttatgctctatgaacaaccaatttctctttcaaatatatacacatacacatatatatatttgtgtcttacatatatatatttgtgtcttacatatataacatatatgtatatattatatacatatctatacacacagagagagaggtaaatctgtgttcatatccaacaatggcatctttatagaagcattatttataatagccccaaactggaaacaacccaaagtggagaatatacattaacaatggaatattacacagcaatgaaaataaattatggctatatgcaaagcaaaatacatcttacagacttaaggttgagtgaaaaaaggcaaatatgaatgatgaccgttgcatgaagttgaaaaacagtcaaaacttatctgtggtgatagaggccataataggttaactaatgaagagaacataagacattctgcaagggtactggaatgttctaaatcttgatctagataataacttcatctatatctatacaaatacagatatagatatgaatattaaacttcacttttggatagagtttatctcagaaatctggagaatgtaggtaaagaaagtggaatatgatcaagaagacacatcaactgagattgcattaaagatatatggaaatttggtgagatttgctctgttttaaatactaaccctttctttctaataatgttacatctttccatttctttaactggtatgcccttcattaagattttatggttttattagtgagtcaagtaccttcatttttcaatttattcctaattagtaaggaattttgttgcttgtgtgagtagggcattctcccccattcccatttatagctgtttttttgcaattagatacttaaggaagctgtggatgtttctttatatatgtacacagaatgtacaaaacatgcattaccattgtaccttgttagttctagaagtgcgtgtttgtttatttggttatttattagagcttcttggtttatattggtatataagcataaaaatcaattgtctataaaaataactgactttctattatttttcagttagccagggtgtaaagaaagtagcaattgttgctcaaagtattctcgagcccaacatgattcatcacttaattctgaaatgtcactgtaatctcatttcaatatgaggaaatccgtacagtgtctcagaggcgcctgttctccatcacaaggagacgactcacaagagatcaggaatgcattttctctaattgattttccttctagatgtgcatgccagttctgtcactttctagttctgaccatgaacaagttatttggcctccttaaggcttagttttcacatctttaaaatggagaaataagttttacttgaatggctctttcaaaggtcaaataaaatatttaatgaaaataaaaagcttaatggagtgactgacacatagaaaggactcagtaattattagctagtaatagttatatcttatacatggtgtttatacctaagacagtgcaaaagcttcatgtttcagaatcagctacaaatccaaattgtacctttctcctgagaccgtaagttattctgtcttgttacccattgctgtcacagagcgtggttcctagaaacaactggaagccatctgcagtgagtttgggcaacctcatggttgtgttgagtgatctgatcccacagctcaggcatctgacagctgcagtattcgtgcctcacttttctgcctgactcttgctcttggtgaaagcagttactgcaccaccactctctggactttttccgctgcatcgtccttttgtcttttcaatatggaactgagattctgtgaacaacagggccattttacagcctataggctgcactctgcttgggggactgagcattctgaggcaggttcctgccctcatcccgttctggtcccatatcatgattgttccagtgaagaaggtgttgggaggtgccccataaaccttccatatttagggtcttctgagctggcagcccactgaagacaaacatggccatgtgtcgatggttgtggaaagaggatgcatattgtccaattgactgccaccagcatggagcatggcatgctggcagaagcacaagatccagaagaggatagaaggatcccaggtctgggggaaactaaactgtttcatcctttgctaagggctggggcccatcaggatgctctgggctgtgaagtcagggcaggagaacaagactgtggaggaaaatgtagtcagaaaagacagtctcagcccacttctcatctgtttcattcaagcctgaatcatgcctcatctctcctcatgctcagcagataacgttggatcaactgtatgttcatttaagtctcctcagcgttcttccttctgatccacccatatttttaccatcatctcctaccaacctacaggcagcctccctgactaacatggatctctgttctgttctgtgcaatttttattaatccatctttgttcttcacatctttgtactacccttttcttccagtatggtcagtgtcttcaccatctctgccatcgaagtttaattcctatctctccctggggatcccctctccagggactgctatcccagtctgcctctcaaaattaaattctaaagaccccacaaaatttttgaggatttttccaattgtcctaaaaggttataatcttaccttacagggaatttccacagaaccactcacattacattcacatttgtaatacatttatctgcattactagactggaacttcctgaggtcagacactggggcttaattatttttgcatctctagtactgcaaagggtaggttgaacacatattggtatttgaataacaaagaggaacatttatatgacgatggtatatggaaggaggacatgaagagccgctcagcaccactagtttattaggaaaatgcaaattaaaaccacaatgagatacccactaaaatagctgaaatgaaaaaactctgacactagtgctagcacttttgcagagcacctgggactcttgtgaattgctggcagaaatgcaaaatcacacagccattttgtcaaacagtatgacagtttcttaagaagttaacatacacttactgtatgacccagcaatttgtctcctagatatttacctaagagaaatgaaaacttacgtttatcaaaaactaactaaacaaaaaatctcccattcctgttacagtggcttcatccataattttcaaaaattagaaacaaccccgacatctttcaactgcagaactgataaacaagctgtaccaagtccatgcaatggaatactattcagcaataaagaaaacgaactactaacatgaataacagctggatgaatctcaaatgcttgaggctgagtgaaagaagtacactcaaatagtttcatatcacataattctatttagatgacattctgcaaaaggcaaaaatgataggaaggaaaacagatcagaggcttccaggggttgaagaaggggtacattttgggggtttgatattaatgttttgtatcttgatatcaatgacggtaaaatgtttctatattttctaaaattcataaaactgcatacctaaaatgattttgtctgtatgtaataatatactttatatccaataaaatataatggaaagaaagtggaaatagtgaaacctctttcttatcatcaatgggccctagagaatcagcaacctatccctagctggctcccacaaactcactactttacccccagaagtcactgagatggtgaggctaggatgtgactatcacaatctgttcctgggtccaaagttgaaggtagtaatgacttaaagtgtttgataaatggggagaaaataaaagtgagtagtccagagttatcaaataatttatgtccagaacatgaactcaaacatttgactgacataaattttattgagttttctttacattaatccaactcagtaggccaatggatagaattcaataaaaataatgtctgtcaaaaggctgacattatttaattttaaaacagagttaatcagtctttactttgggctctcctagcccccgtgtataccccttgattgcagtatttattaaaatgtattttaattatgtttatatcccagtcttccccaccaggactttgggttccttagggtcagggattttaagttactgatatttgcactccaggtgcatcacaaagcaagtgctcaatacattttttgttgttgttgaaaaaatgaaaggatgaatgagggctcatggtttccactactacatatgtgacatgcccatctccccattctatcttctgcttctccataatttgcccactgccacacatctctaaattctgcagaccacccccaagctgtccttcctgtctcatagctgcagcaaaagccctcttaacgcccactctggttcctgctcctcttacaattctgtacccagacatagacatctcactgaaacattaaacagatcataccgtgctcaggcttaaatctgccagtggtttccaattaggcatagaacaaaaatcagattccttagttaagctttggaagccctacagttcctgaccctttctatctctgtgaccttgtgtctcactatctgtcttggccaatatgctgcttaccactgaatttccttcagggtctcacacatgcttggttgagtcagcctcatagcttttgtgtgagcagctccctgacctagaatgtattttgttctgctcttcatattgctggtttcttctcagcatgagatcatggccacaacatccacttttccaagaggcctttcctgacacaatctaacctcactctctaacacactacctcatttaacttctctgtataactctcattccaatgggatatatatgttattcattgtgtatttgacaataattctgtcttcccttttggataatatgctctaagacagcaggaactctgtcttaactctggtctcctcatcaccaacacagagtaaatgtttaatgaacacttgttaagagatgaacagatggatgggtagatggatgaatggacagatggatagatggttggatggatggatggatggatggatggattaatggatggatggatggatagatggatggagggatggagggatggagggatggatggatgaatgtaatggacaggtggaaaggaatgaatggcatctttcacggaaggataggaacagctattattttctaacaaacagaaaacccaaatgaccttatccatagacatttcttctactctgtgttacactgaaatgtgttgcagaccacctcactgatgcctgtctttatctgatgtgcattatttacattaatagaagaggaagcagggaatcagacactgacttcagcagggtggataaggaaattggaaaaaaatagtagggaaaaagaaatgtggggatgttacatactttataattattacagctattccagatctgtacaactccccattccctcttagatggcaattggaggcacctgattttcttctatcctcctaaggtgaatgctcactcttttcccctcagcctgttcaggccacagcatctatgtagcttgtagacaaggagatactgacttttacctcattaactctgtctgggaagcccaaagtcatggttagacctggcacaaaacaatagccgaaaaatcagggtcatctcctttccaaatggcaatctgctttactgaggccaccagaatgtaatatagtctctttgcctctgccctgtacaaagatatgaatctgggtattttgttataacttgaaaatcaaggcagacgattaaaaaaattactctcagcaattcagttgaataaaggctttaatatctaaaatgaactacaggtgtaccctggcaattttaacactgagatttctccaaaaccaaagtcagatggagcaggtgaccaggtgccagagtttttcagacagcaatttctggagccagattccctgagatcaaaccttaccaactaaaattgggcaagtcacttactattttcatttctcagttttcttattatgcagtttgtgctggtgtggtaagaatttcatgagcaaatgcatgcaaagcactttgcacagtgactgccacatagtaggtactgagtacctggtgtatctactcaaagtcattataattaagtgagtgaatagcttcagattttctttactctactctgaaataacaccagtcctaagtcactctttgaagcatcaattgctgaagattataatagttgatttccttcagtgataattccacattgcttttgtgctgttctttttccagagccttgggatggcaaggtatgggtaagatgggaacattttgccacatccattggcagctggagtgaaattccagcaggcactccaaatccatagctggtaagaatccagctgcagagcgctgcaggaagtaaacaagttccatccactccaacttccctctgttctacatctggggattcacagccacccccagacttcagaacaccctcatcctacacagtgggtcaactgacagaaaaaaacactgctatgaaggataatgtgtttgctgcagacaaaaatgattgaggccaaggaaacaactttttcatggtagctccagaaatttaattttaaagagcccttgagagaagccagtgtcttcctcaagagaaaagatggcaaattgtatcattttgattcacacccatgaatgatgtttctgcagctgtttgaattaagactgaaatacaagcaatctcagtaggagtctgtattttcataaaacaatttcctgctgagttagttcagccagctctaccccagacctttcacacacctcggtgatgaggacatttacaagatagggttatttttgcttattaaagagctcacggagttttgtaatatccaactcttctcaaggcgaaggaacatctctggatctccccacacacatatctgaaataaaatagagttctaacctgtcctagttgccactggaaaactctgtaggaactgcacaccaaagaacacagtcctagccccaccagaatgagatttctcatctaactcctgctttctttctttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctaactcctgctttctaaacctcttgagttgaagctcctcaactcaaaacctggctgtccccaaccccggagtcaatcccaggtgaatgcttggtccacctgtacccactgagctgtcacatttccctacattcccagtagatgggcagcaaatgcatgaggcttttcctaaagcaactgttatgccctcaagggtcctcaatttcagacccctttgctcagttcctgacttcctgacacagtcttatgacttctttactggaaccagaatgctgtgtcctgacattttgcttttactggagaggaagtagaattctttattcttctacactcctctatgtagtgggagcacgctgggagggctgtgagaatgagggaggtgcatgttatatcttctccttcacatatactctcacattctgtattagtcagaaatatccttagaggttataacaggaaacctaatttacagccattcaacaagaaaaattccatctatttggagtttttttacagcatgtaacagcaatggaggtaagttgttgctggatttgattgagcagctccaacatggaaagactgagactgttctgattcttttggccttttcctcatggttgcaagacggctgctgaagcttcagccattatgtctgagaccaaagtaagacagaaaggaaaaagtgtttttcagaccttttgtccccataccagaaaagcaaacacttagatctaatctatcaacaaataacatcaatttacctcttcttggccagaattgggtcacatggccacccttagctagaaagaaagatgtaaaagggtgaaaataattgttgtgatggtcttagagcagggcttctcaacctcagcattatcatttggggatgaataattctttgttgtggagagctggcctgcgcacggtaggttatttaggaatgctcctggactctacctaccagatgctcacagctattttctcctccaggtgtaacaaccaaaaacgtctccaggcattgccaaatatccactggggaatgaaatcgtctgtggttgagaacgactagcttaggccaatcatgactcattgtctggtttaagatgcatggctaccctgaagaaaagtagggtatcaagaaggaagaataagaaaatatgtgcaaggtaaataatcgtgtcatgcctcagacacacagcctagacatgcatgtcatacctacacagtacacacccgcattcatgagcacttgtttggcgcttggagtcatggcataagcaaatgttcactggtgtggagaaagctcttttctcttcagactcctttccctatgtatttacatgtaaaatgtaattgctttggttaaatgcaattaaattcaaatcaattaaatcctttacatatttactgccataaaccaaaagtttagcttgagttaagcctgaatgtccagaaagcggagccaaagaaggaaatgtctccaaatcaagagatgcaggagctggagtgaaggataatgaagaatcaaacaaaacctcagaaaactaaggtatgtaagaaccagaaaaaagctaaatagtaaacacctatggtgtgctatgatgaacacttatgaaaatggaaaagaagttgttaacagcaaaaccagactcctctaggcaaggacaacttatttagtgtggcccaaagcaacctacaccatactgatcttcatgagtaacaagggaaaacttttatgttctgccccaaataacatctagggctaagcattcaacatcacccctgactgtaggtactaagtggcataggaagaaagaggctatcgctattatggggtcagagaagaacgaacttccttagagctcatcattaacttaggtctgtacagtagtaaataggaacataaattgctataggtaggaaaacactttgtacccctaattctgggagataagccttttcagacacagagactgagaattctttgaagtaagactgaaatctgatatcagaatgttattgtccccatggatgagatacattaagaagcagaggatcaaaagattattcacaacaaggaaataagaaaagtaaatttggtcagattagaggagaaatgtttatactcgccattcctagccaagactttctccaatccctggtgataaacttgggggtaaacaccttaacggcattataattacgtgtgtgtgtgtgtgtgtgtgtgtgtgtgtgtgtgtaattacttcaagtttgttggtataagcagtgcatttgtgtgtatatgtgtatttaactatcaaagcatttatcacattctgttttgatgtttaagttacccacctgtctcccctgctagactgcaacctctgtaagggtagggctgatgaacactatgtgtgttaaataattaaatcccttttaaattcgtgtatgtatcaaaaacatatttaatacatacttactaggcaccaaataccatgatgggtgctggggacacaatgctgaaagagggaaaacacacttagacacacacacaaacaaaatagacaatgatctttgtcttcacagagagattttagtcaatgtcaggcaacataacatttcaattgtgaaagtctatgacttggtaattggtaatttgacctaaatgagaagtgaaaactccagatgatgaagagaggtgagcctcctgtgtgctaactgggggtgagggtgagataatcagtcatccagtaacagtctatgaggcagtgaggcaaagaaaggtggaaggatggagagaggcagtgttgagcctggaatggacctttccacagggattcttcccactggtaaagtatatcccagtgaatcttaagctataaccaatcataaggtgtagaaaaaaaaaggcaccatgtgtcattccctacattcccttctgtgaggaggcacagttttatgtgaaaccaacatttacaaagactccaaggaagacagtatagacttacagcatctgagcacttaaattggacagtgcagtgcagccactatctcctgcacacatgttagggtgaggtctttgttgtacgaaacaacagagataataaaatggaagagcagaagtggccattctaattcaaagatggcagtaacatgtagtattgaaaataatagattctaggccaggagcagtggcccatgcctgtagtcctagctacttgggaggccaaaatgggaggatcacttgagttcaggactttgagaccagcacagccagtttagtgaaatccagtttctccaaaaagtaaataaaaaattagctgggtgtggtggtgagtctgtagtcctaactacttgagaggctgaggtgggagggtcacttaagcccaagaattttgaggttacagtgagctgtgaatgcaccactgcactccagcccaggtgagaaaatgagaccctgccccaataaaaagaaaaaaagggaaaagaacaaattctgcaggcagactacctggactcaaaccctggttctcccctctactatgtgtataacagtaggcaaattacttaaacttactgagcctcagttttctcatctgtgaaatggcctaacaacagtacctactccatagggttgttgtaattactagatgagtcaatagaagaacttaaaggagtgactggcactcgggaaatggtataaatgtctgttgaataaactaatatcagttttaggtccatgtgcatgcacatgtgtgtgtacatgtgtgtaaggacctgtgtgcatgcacatgcatatacatgtgtgtatggacctgtgtgcctgcatgcataagtgtatgtacatgtgtgtatgaacctgtgtgcgtgcatgtgtgtatggacatgtgtgcgtgcatgtgtgtgtggacatgtgtgtatggacttctgtgtatgcatgcacatgtgtatgtacatgtgtgatgaacctatgtgcatgcacatgtgtgtacatatgtgtatggacatgtgtgtattcatgcacacatgcagttgggtgaggaggagcctcagttggtctgaaggggttccagcatattctactcttgggaatatttcctgctgggtttcaggaggaaatattcaagttctgtacactaaattgaggactggctcacctaaagcaagcaaaaactaaagagaggtggatgctaaaagagcttcctccctaagatacagagcagttttcactcgcagccttgacctcggtggttttgtcacctaaaaccattctagtttcaagactcaagctacaatgcttttgagaaatgatctaataaaagaattaatagaactgtggcagaagtgagccctccaaaactggtcctatagaagcttctgtcttagatgttttctggggccagacaccggatgccctctttctccaggcatctcaaaaatagccatggtatggacaaccagcaacatgatgtcatacccataacaaaactggaattctttggatacatagctggagttttctccttctgccctacaaatgaaggctaggggtcttagaagcctccagaacaccattatttttcttctccattagactaagaagcaggcatcattcatttattataatggtgttcttcccacattgttactggcacattctgtgctttacaacaacaagaaatgaaacgtcccctgagaagcctcaggttacatttatttggctttcctttaataaaaaaaaaaaaggagtaaagccaggaatgaaagggagctgagagctgatgtactttcctgactgagttcaaggaggcagtctgtggtgaggccagagatgaacagggctggccactagcaggaaaacataagtgacggcttctcccagtaaccatatgaaaatgggctgatctgttctgggactcaaagcctgtctccctcatttcacagaaaattcaggagttttccaatactcagagaaccttcagaactgtgtgggtttgatacgttttcctaacctgtttgagtgcacagttttggggaactttcaaaggccagggtatgactttggaataaaatctggtttaatttcaggagaacacatttaattctgatgatatctaggcctcaggaaatgaaggcagaatgagatctcccagatttgactggttgttcatgccagtttgtatcagtaaaagctagctcctcaaagcaaaccagaactcagattcctcggggtgggaaagtgcagacagtggactgttgtacccaggaagcatgcctgaggtgctgacagaaaagaagtttcaatacgtgaatcttcagcccttcaacatagttcactataatataggatgattccagaggtgagaggagtgagggtgatgacggcaataattatgcaaaaattcaaaacagaagagacttgtgtaccctgatgtctcacctgtccactcttcttgacagaatccctcatacctggcagcaccaggactgagctttgtaaactgaagactggctgggttatagtcaaatggtaaggcagaagcaaaataccccaattctgaaaggagaagacttcaacagccagtgatggagaatttaatcttgggtcaaagccacatgagggctgcaggaagacaagccgtgtaaacaagagggtctactttttgaaattgctaaatacagattctgtgcctgaatgcctctgatagtagatctcaaaaagagggcattctgaattcttgttagaacctctcactgacctagtccacagactgaagctggaatctagagaacaaagagaagattagtggatagcttagcttttgctgcataagagaccacccccaaacctctgtaactgtaagcgtttatatacctctcttgatttttctgagattcatgattccttgcctggaagattctgattgggcatggcttggctgaggctgggtggtctagaatggccttactcacacatctgatgattgacgcaaagagctgtggctactggaatgatttaactatgtatctttcatcacccaataggctggcttggcctcatttacatggtgctggtcacaaagttctcaagagtgtccagagaaggccagctcaatgtgtgcattcattttctgagcatcagcgtggctctcattgaccaaagcaagtcacataggcagtccagagacagtgtgggatggcactaccaaaggtcatggatagagagaagaaaataacacatggccacttttacaataagccacaagttttctcccttccacccattctgtttgctcctgatagaatctcctcctctgtccactcacagtgactggcctgaaatacagttactaaaaggaaatctccccaacatacatagtgaatactcagttttggtgtcaatagttaacaagattctctcgtttgtcaagggttggattaaattaggatggtcagcatgttcctaacactcactgtttaaacagaaagggcacactcccattcgagttaagtcacaggctcaacagtaagtgtattttccatggggtaattgctaaagccactgcttttccaagaagaatccttttggagtcttttgttcttttgattgaaacttaatcagcttcttgtttgacaaaaatgacaggctgcatgaaaggggaaacagagtttgggttttgccaatcctaattcctatcaaacatcacaagaaaataagcactttctacataatgttctccactttgtgttttagactcaaatttatcacttaaaaagaaaagaaaaaaaaacaccctaactgtttatattttgggggaaaaaaagaaaagcgatggttaactccttctttctggggtttttcatgttaaggattttttaaggatcaagactcttgactttacctttcagtttggtggggtagagatatagggaagcaaaagttcgccagatcacttccagatgatacgtcctgaaatctgtcttccttctgtcacagaggacctaccctgcagtcaaagtttattgtctcccaagtctcatccagacttccaattctgaccccaagccctcatgctgaatttcataaagagaacacacatttctaattctgttatgaggaaagcactagatttgcaattggaagcacattcatcttggccagagactcactagctgtgtgatcttggacagattaaattcattctctctgattctgtttctgcatccatattacttctctatttgaagggtggctgggaggtttaaattaaagaatgggcatcaatgtgcaaacctggggcccaaaacttagtaagggcttagcaaatgttaattttatcctatctgatttctttctttccatctctttccatattattctcattttcccattctaggaaaaaaaatgcaggctagcatattccctttgaatgaaaagagaaaaagccatgctgttaatctctgtgacagaaaatatggaagacactcaacagagagaggcagctttggccagttttatgcctttgccagtgcttagttgtggatagacatgtaactctgccccagccagagctagacatatgggggggaggcccatctttctacaatcccatgactagtaagtggcagagcctggatttgatccccaacagtccagtttcagaatccatgtgcttttctactaagctataattccttgctaatataaacccattcattcattcattcatttatgcactcattgtccaaaaatattggctgggtgttgtggctcacacctgtaatcccagcactttgggagactgagggggggggcagatcatgaggtcaggagatcgagaccttcctggctaacatggtgaaacgtggtctctactaaaaatacaacaagttagccaggcgtggtggtaggcgcctgtagtcccagctactcaggaggctgaggcaggagaatggcatgaacctgggaggtggagcttgcagtgagctgagattgcaccactgcactccagtctgggtgacagagcgagactccatacaaaaaaaaaaaaaaaaacaacaccaactctgtagagcctatgaatgccaatcactatggtgaatgttgaatctgagcaaagctgctagggaatcccacacaggaaggcagtgaattttgtctgagggagaaaggcacaagtggactcaagtctcagattcattatttacacgtgtgatgttctgcatgttagttgaactcagtgaattgcagtctctactgtttttgtatagggtggattcgtttgggtactgaagcaaagtgaaaacagctaacccaaagcctacaatgtggtagttacccgagaaatgttctttaagagaattcataaaaaaaaggaagaacactgtacagggatatttttaaaggatcttcagggagacagagctcaggtggagaagagaagcaaggagaggacatgggtaacaaataatagggccagaaataaccatcttggatgtaggagccagggacaaacaggcctgagaagcactgtctggcctttcagagccccgcagctgaatcctgaccctaacacatatgaaaatggggccttggccaagttgctaaactgagaacctcaatttccacatctacatcagagaggtgaggatgtccccctcccacaaggtgtggaggttacatgaggtcactcatgcaagtgccatgttgttgatgctgcgtggtgattgataattactcaataagtaattgtggctcacatgtttatgacagcaagaaggatgatgaatgttgcagggtggtggggggatggacaggtcacactttgtagggctttagggttgccatcagggtccagacaacatttattgtccagtccattgataatcctgattttctcctggcttcaactaagtattttggactctaagtcaagggtcaaaccaccagtgtctccacctccatgtgtgtctctgatttgacaggctctaatgccagggctgcccttaaaaataatcctttttgtcatacacacagaaaaccatgcttttccaggttgaaagtggatcccatctcacaaaagtccagctcagattgagaatttagagccataaatgctaaggaggtacaatgctcagaaaagtacattagtacttcttccgcagatgccccttagaaagtcttacatccagagtttggcttccaggtaaatcatttctgaatcaaggctggcctgacattttcaagcacagccagttgcacttgcctctacactccaccttccattctgacacttttcagtaatgctgttaattgcttatggatgtatctccccaaacagactgtgagttcttcaagggcagtgcctctatttaattcacctgtgaattttaatcctgtggagtcaactttctgtagataatgcctgaacaaaaaaattaagaaatataaacaatcagccccagagccttgctgttgggagaggttggactctctggggcagctttgccccaggatatagttccaggaggtgggttcccaggcggaagggagaaatacaaatgtacaagcagatgacagcccgtgagctggatatgtcccggaaataaaaactggacaagtcataaagtttcaggccaacaccaaaggaagaaatgctgggtctttacatagaactgtcctctaaccccctagtgactagcaattatttcctcctgccctgctggctcccctacaaagcaaggggcgtccagtgaggagttctgagcccagcataagcaaagcaccaaacacggagtgtgtgaccctaggagacgcagggaatctcctcctgcatctctgtctgtgactgtgttgtaagagatgaggacgggagaaacaacgggagaaaactgtgacaggagaatttgggattctagcagaaactaacaccagaatcttgggcaaaggacacagaattctaagagagaagtttgatcatgtaccaaatagtcagagacatatttgcttctatgagagatctcgttcccttaagtgaaatgccagaccctaaaatttctagttatccttaaaagagtggacacacaagaaaaggaaggagggagggagggaaggagggggtgaggaagggagggagggagagtgaggaaaggagggagggagggaggaaggaaggaaggaaggaaagaaggagaaagagaaaggaagaaaagggagaaagatgaaaagaaatgagtgagaaaagaaaggaagaaagaaaggtgaatttccatcaagtaagacccagagaaaagaaagaaatgacggcagctgaaccacttttctctttcctttttaatctgactttagatgttctcctggtaaaatcattacaaaggccgtttatttttaaaattgaaagattgggaagagtcataatgagatactatgtgtaaaagttgcacataaatttcctcttgtcatattttgggcttcactaacgcatccccttgacaggacgaagggaagttgatcgctttagtatagattgtgcgcgcctcagaaatattgccctaggagagagctcctgggtggctgacttggctccatgctgatttagaaattagccgggcttttattggccacactaaattgttctcaggaaaaaaaaatacatttttattacagaacaaggggcagatgattgaaacaagcctgccttctccttcatttggagctgtgttttagactgttaagttgactttcttctctggggttctcgctgctgtttaatgggggcatacaatatctaccattaaagaaattaccttgtttctctcagtgtccccagggaattccttattccttaataaagttctgtttgagttctcctgagtgcatgagtgggcaggttgaggaaaacggagactctctatataatattcctattgcaagggtttagaggaaggggagaccaggagccgtccttaaagaagggattcagagcgactgtgagtctggccactggccattgactccagatctaaggccagaggtaacactacagaaatgcacaccccaatcctgtattgagtgaagcccacggcagggccgtgcaatgaacttgcatgtgaggccaaacctgtcaaaagccacttggaccaaagggaatcattcatttgtagagaatgcccaaacccactcatatccaattctgttctcttgaagtccagcctgactcctgtctccgactctgctttgacaggcggccttaggctcttcctcagttctaaacagggcattgatagattcccatggaactgctcactactgccctccacaaaactgcctgcctgatttcagacagcctcttgcttagaatctgttctaggtacagaacccctagcccttctccaggagaaatattatgtccatatggatgggagcagctagaggatttctggaaactttctaaagattagtttcacttcttgaaagctaaaaggcaaacatataattgtatccaaagtaaattactagagtaacacagagcaactggggtatttgaggaaggaattgttcggccaactgaaccatttcattaacccttcaaatgtgatccttgattttattttcttaaatacttataaaatgtaagcaccttcctgcattaatatgcaatatgatggagcccttaagatcttggactcaaggtaagtcagaattgaataggacacgtttgctgtcattttccaaatataggtccttgggcaaatcacatccagtttttctgatgcggttttctcatctataaaatggggatcatcacagccctgctagtgagaactttatatatgttgagtttatatatgataattttatatatgttgaatttatttaatatgtgaaatatgttaaataagtatatttaatttaaatatatttaaattacttattaaacagtaagtaccacacctggtataacatacaaactcattaaacattagctgttgacattgctcaccatcagctcagcgctccttagctgaaaggtagatttatttcccccacaagctaaattctacaatagagccaagtctcacaaaacgttagtggttcagctgagacagaaaacataacttttgattacttatcctcctccactaaacttcagaccacactgcctcctattaaaattaatttctgttcccttcaggtggagatttaaatttgtcatgcctccctaagccactggacccatagccctatccctgatttttccttagggaagccaggactacttgaggtaattaatccaccacaggctcccctaccacaactgggaaagaaacaccaaattctacttggtttcttactaattaggaacagagagagggagagagggagagagactaaggacgggaaagggctgagctaagtggggtgtggtccacatgtgttcccaatcatgaccacacaatgaaaatgttttctttctggggcaatcaggcaaaatcttggaaagatgaacttttttccccgcttctttatgtacaataataacaatatcccaaattcaaaactttttttttaatcttggcacaattttgcttctaaaacatttggaaaacatccaagcactgatggcctatgcctgacccttttctctgaggtccaagccacttattctataataataataagcgaacacatagatgatgcattctatgtgccagactctgttctaagtgctttacaatacattgactaaaattcaatctccttcaaaaaccctacaacttaacactatgttcatccccattgaacagatgaggaaactgaagcaaaatagatttagcaacttctccaaagttaatcagctagtacagggcagaggcaggatttgcactcaggctgtctgaactctagatttatgctcatcattatcagctcatacttctatcatgtacctccatggcagaagggctaggggaaaagcagagggctggggctgcccaagagttgaagatcaggaggcacaaaaactaagaagagaactcccaagaaagttggagtactaataggcaatggggtaccagtccctcttttgagttgtggctctgcctttctggttctacatttactcagttcatgaaccaaacacctgtcaccattgcccttgttcactctgctctccccatgctcttcactttgattgacatgcaaactttattctcttacactcctgaccttgaattccatttctagcctgagtgtcccctaggccctgaccttcacacctccagacccagccaagtacccggattctggctcctaattgctccctttgcttaactgtctagttgaaagttcagaccctgaatcagcccttggctctgattaattgcagcctggggctcagcagcaggggtctgaatcccttcccagtcactggagtagccagacttgacctctgttggtggagcaatggaggatgccatgcctacttgttgaataagaaggctgctgtgaaacatactacatgagttggtgcatatgtcacagatgcaactctgccaacaggaagaccctcaggggctgactgccatctgctgaaaggcaagcagggatggatggatagatagatggatggtatctgacctctgattccttccagggttagatttttggagagtgatgttcaggagcctggggaaaccatcattccaggaacagctggccgaactggcaccatggagcaattgatggccttcaagtgcagagattaagtttaggccaggaaaagaggcacaggtctgggatacagggcagtgattcaaagataatggatatgagctaactgaggagaaggaaaagaactgtacaatatgtgagggatattgatggtggaggattccattgtgcggttcccaataaatgcacacagttcaactctaaggcctgatctttcccgtaagactggagagtactgggagatacactaatctctcagaatagcagaaaacaggtgccttgcttcctggattatccaggaacaaactcaggggcaaactcatcagaaatgacataaagaaagcacagagaattaggagctatgcaacttatatatgctaatgtatgctgactgcctactatatgttttgagctgctttttgatgtattcattagcttcctagatggggttctaataaatcacatacatattatacattgatctatagtctatatcacattaaaaatcagctcacttaattaaagcagcaattgtgtgaggttataatcatattattttcattatctcattttaaaaatgaagatattgaagcacagatagtcaagtgacgtgcctgaggtcacaccactgctctgggctagagtactattcacactgctgtcttggtggctgtgacagtgactgacctcctgccttccaggtgtcccatatcctgttgctgagccccaagagtccaatggaaggggtagcctatatgcaagcagtcctgcccacatgggagagtgatgagcaactggcttatcgaggtcaaccatgtgctctctcctggaaattcagaatggagccatgaagtgagcaaataatgatggaatataatgtacagtttggtaaagagtgctaagagttgacaaccaggtcagacacagctgtatatactcaaaattcctggggaagaagaagctatgagcctgctcagaagagtgaaaggatgagcattttcccagggtagaagagaggccaaagacatcttgtggcattcagtaggtggaagtggtagcttcactgtctgattctcaatcagatagctctgtgtcctggctacaaatatgcttcctgtctttgagggtcatgtaatcgatcatgtcaaaaatcaatattgactagtttcctttttggtttaattaaaacaatccttccctaagagatgagcccctttataaatggagattatacctgagttaatgtgtctgtctgagattaaaactgttaggaaataataacgatggtaatgataattacttgaatgtttaccaggtaacaagcactgtgcttatactttatatgtattatctaagttaattctcatgataagcctataaagtatgtatgattgttattcctgttttaaagaagaggaaattggggtttacagaggttaagtaattcatttgttcattccacaagcatttattgagtgtctgctatatttcagtcacttttctaggagtttgaacacgtcagcaaacaaaatagacagagatcactttgccttcatggaaagtatgttccagtagggaaaacaggaaacaaataataaccatggcaaattagtaagttagatatggtattagatagcaaacagtgccatgggagtgaaataagagatctgggtggaggctacctgtagacacagggtggacgggagtgatggattgtgattttaaatagagacatcagggtgtgcttcattaagatagttatatttcagcagaggcttcaaggagatgaaggaaagaaccatgggggtatctgggagaagaagattccaggcaggggaaatagcaaaggcaaaggccccaaggcaggatcaacagcacagaggccagtgtaggtggagcagaaaggctgatggaaagagagggaaagaggccagagaagtaacaggaccaggtcacaggaccttgaaggccatcataaggacttatttatttatttatttatttatttatttatttatgacagagtctcactctattgcccaggctggagtacagtggcatgatctcagcacactgcaacctccacctcccgagttcaagcgattcttgtgcctcagcctcctgagtagctaggattacaggcacgtgccaccactcctggctaatttttgtatttttagtagagacaggtatttaccatgttggccaggctggtctcaaactcctgacctcaggtgatctgccggccttggcctaccaaagtgctaggattacaggcatgagccactgtgcctggccagaactctttttttcggtttgtttttgagacggagtctcactctgtcactaggctggagtgcagtggtacaatctcggcttactgtaacctccgcctcctgggttcaagcaattctacctcaacctcccgagtagctgggactacaggcatgcgccaccacgtctagctaatttttatatttttagtagagatggggtttcaccacgttggccaggatagtctcgatctcttgacctggtgatccacccatctcagcctcccaaagtgctgggattacaggcgtgaggcattgtgcctggccaggacattttagttgaatgaaattgagacctatcagagagtttttatcacatgcataacttcatctgactgaacctcttagaaggactactctgagaagagtcaaaaccctaatctgtaaggccatacaagtgtaagggccagaattgaagctgattttcttcctaagttttatgctatgtcccctctggctctaaatgttctggagcaatgaaaggctatttcaagtctttttcctttcaatatggtctagtagtttctgtctttgctctgacatgagaagtctcaatagacattttatagtattgttttcacaattcaaaaaataataatgaatatcagttaatattgatgaggcataaggttttactatttgccttgcactgaactaagattataaatgtaccttctcattcaatccccacaatgaagctctgaggcagtcgtacaactgtgatcctgctgtgcagacaaggatctgagacttggcaagtttcctcactcaccctgattcccagggaactcaaccacttaaaaattacccagaagacctgccttgggataggaataacccttcaagccactcctcactgaaaagtctgcaagtccgtaagacagggaaccaagtcacacacttctttttagtaacctctgttcctgggacagtgtcctgcacatagaaaatatcaacatatttatgttgaatgattgatttatgttaagaacaacttctagccatgttaaaacagatctcagaagcaccacatatttccttagaaggtcattctaattccattacaatccacagagcagtgtgttcaatatggaattcctagatgccatgagataatgaaatttcaagtgggtaatgaatttacttttgccaacccactaacgcatactaggtggactcaaatcacaactcagccactcccttccataagttatttacccaatctgggcctcattttcttcacttgtatatagaaatactactaaggttgctgtgattattaaatgatccgatgaatgcaatttatctatacaatgggctggacacagtggctcatgtctctaatccctgcactttgggagattgagatgggtggatcacttaaggccaggagtttgagacaagcctggccaacatggcaaaacccagtctctgataaaaatacataaattagccaggtatggtggcacctgcctgtaatctcagctacttggaaggctgaggcacaagaatcgcttgaacctgggaggcagaagctgcagtgagccgagatcgtgccacgacactccagcctggatgcgacagagtaagactctctttaaaaagaaaaacaaaaaccacaatgcctcgtctattgtaggtgctcaagaaatgttaccttttattacagggtaagtttagaatttcttttcttagcccagagatgctgaagtagatttgagtcagacagaggtaaactttgctgggagacagaaaatccactgtcttctaggccttcagaaatatgtgctataaaggtgctgtatgatggtgtagcatctgccacttgccagtttctgtagtgtaaatacctccaccatgttcaatttcaagttaccaaggtgatgtcacttaacgtggagttgggaagatgtgtgcacaattgactctcaccgactctgttccaactactccattcaccactattttccctccatgctggcctcctttttccagctcggaatgtgccatcagcccaacaggtacaggcttagtcccctctttgctccatatagagacttatctttactacctgcataaacgaggtgattcttactttatttttaaaagcatttataaaatgctccagtctaggcacttcacatatattaactcatttgctcatcctttgagattatgagactattactcctacttgatggaagaagaaaccgaaagccaaagaggttaagtaacttgcctagggtcacacagctagtaaatggcagagccaaaattcaaattaagtggcttggctctgagttcattctcatatccactctcctggccagacacagaactgtggtgggtctgagccaggtcattgcccagaaagaaaagctagagaatcctactggtcactctcaaacccctttgctgggctaggaccagcctagcagtatttttgctgcatgtttcctacttctgtaaactcattctattctgagttggttgtatgccagtcagcattagcaggagcctagaaagtgcctcattctcttctccttttggggaacttatctgatcactgtatcaatcctcctctatgagtacaggagtgaagacactgcggggagccagcagccaagtgctgcactgtgacaagagagcctggggtgcctgggactgaggctctttgataaatattgcttttgcatttcccatagaaggtgcaattcccaagtcttcctgagctcgcctttcataggccggagcagcacccctgctacgtctgggactaggtttccaaaggttgttctggcagccagagcacaacagctgctcagcaatgagatgatcccgcagccccagaggaggaggggtacggtgagccctgctgccctgtgccaagcccagcacccaccagctgcctctcttctgcttccattggagcaggaaagcattaaccctatcagcaccagtgggcaaaggcttggaagaggagcagggtttctggaggttaagttgcttgtaatcacatagctaggagctcagattcatccacacccttttcactcctagaatgtttaacttttgttctgtcttctctggtcatgaagccactctgctgagcattcttttctcatcttgtttcgatactattcttccttttcttttagccagcagcctgcaagccatagtcatttgcaatgcagtctaaccagtaagttataaaaaaagaaaaaaacacacataatagcaagttaagtggattctaacatttagaggaatctataatgattagaaagccccttattatgtcacttctctatcttcacatggagtcattagcattcttggccaccacaaagcatgagcagaaactcagtgaaactcctgctgcttgacagagagaggaatgcttcatcccagatattcatactataccaaaggatggaatggagacttctggattcctacctccgagatccagtgcgacataagccatttggggcggggcctggatccctaaggacaagaagcttttaagccaagcagaaaacaaacaaaacaaaacacaacacagacacagatgcagacatgaataaataaagcagacaaatccacatatgggaaggctccccatcctgttcccgggaggcaggctccctgaggccttacagatgtcggagcagaatctacttacatgttccaaattgtgcatacccagtgcccactgttactctcagaaaattggagtggaaaaggagaaacatctttcacttgaaaaacaaaagacgtcccccacccaaataccaacatggctgtgatttcaccatcattacactgagatttgccccagtggggctttttaataattattccagctgttggctgagttgagaatttgcacagcctcagtggaggtataaccaggctggcctggtcccgggccataaagagaagtgacataagactaaattacctagtgggtttgggggaagtggggaaagagacagataattaatcaggaatcgacaagatgtcttcaaaaacctgtgtctcggcctttatgaagtccttgttcacacaatcttggagaatatacatttataaatataagcagcactgatttttcaaataattgccagctgttagttttctaaaattaattgcaatttttaatggcaaaaaaattaggtttatttggtaggaaaataggaagtttttttttttttttgagacggaatctcgctctgttgcccaggctgtagtgcagtggcataatctcagctcactgtaacctccacctcccaggttcaagtgattctcctgcctcagcctcttgagtagctgggattacaggtgcatgccatcacatccagctaatttttgtatttttagtagagacggggtttcaccatgttggccaggctggtctcgaactcctgacctcatgctccacccaccttggcctcccaaagtgctgggattacaggcatgaaccaccacacccagccaaaaaaaggaagtttataaaagagaaaaatatatttttctgcacaatgatgatttgatatttgtgttttccattgagtttgtatgtatgtgaacatatactgtaaataattgtaaatgcaatttgtattctatatttcattgcctttttcattcattttacttcacagtttacatatttttcacctatttggagtcttcagagtgaccagtgtttaattgatacatatttttccagttagtgaaaattccaccattccagccattctcttgtaatcaaatttttaggttctgtccgtgaaccatatgttcttatgaattcaagttttggttctggtgaattattttcttgggacaaattccattgagaaaaatgactgaataaaataaaactaattctgtgacttttgttacatgttgtcatgctgcttcccataaaggcttgcatgggttttaaagcaaggtcaccataagaataaatagacaaaacttataaaaattttgtcagctctggacatcactgtttttttaaatttgtttttattttaggcacatttaaaatcttctccagttcttactctttatgatatcgaatatgatactcattaaaataattttttaaaaaaacaactttcattacattttactctaggaaaacaaatccactttattttagaaattccaaagaattccatccagatacaatgtaattcataccaagctggaagagggtgcttgaaattaaagactatattttctggtagggtggggcgtaatgccacttgttaaaagataattgctgtgttgtaaaacgtcagctaggcacttctgaagaacagaccccttaatctgaagagaccgggcgtggttctctaaatgtggaaacattttcaaaaaaaatcaacaaaagaacatctctctggctgcttggggttgctttctcaaaggcagactatgattctggcaagataatgagacttagagttttagggccccggatactctatatacataccaccattaaagctactgcttcttctgctaataatattaataataataatagttactctagagagataagaaaaacccaaagtgtttttttcctattcacattcaccactcaacacaacacttctgatattagatgtgtggagttctggggggaaaaatacatcaaccaagcaattttgcatagactcccaagtgggtgtcttctaattcaagtcaattttgacactatatacccagagataccatcaaatcccacaagcgtgggctcagtcagtcccacaagattgatccccacttcagattccagtcacacatagtaggttttcacctatatttctgacccatcagctataagttgggggttcgttcccatgacccccttctcaggcttggttaatttgctagagcaactctcagaactcagggaaacatttgacttatgtttacacatttgttataaaagctattagaaaggatacaggtgagcaaccagatgggagggatgcacagggagaggtctagaagaagggacatggctcccccatcccctctctaggtgccaccctctaggcacctccatgtgtccaggtatctgggcagctgaaccatagttcagggatttttatggaggcttcaccacacaggcatgatcgactattaagtccatttctagccccttgcctccctctggagaatgggaatggaggctgtaagccccaaacttctaatcctggcttgggctttctgttgaacagcccccatccaggagcccagaaatagtaccctcattagaaagaaaatactcctatcacccagaaaacaccaagggatttaagaactctgtgtcaggaactgggatcaaagacaaaatactagaacaaaagattgtcctagcaccactattgcttaggaaattataagagttttagaagctctatgccaagaactgtagtcagagaccaaatatctatttcttattatattacaatatcatagctaatatttattgagttctcactatatgctaaagagtgtgctaagcactccagtataaatgatctcacttagtcctcataacattattatgctcacttgaagagtgatgaaacaaaagcacataggcttagaaacttgctcgggccacacagcccattcatggacacaaacctaggatatatgaaaataggctttgatttccgcagccacactgtggtttatctcttttggtaaactttcagttaatagctccatttttacttccccagaaacttgtaacaaatccatatgttggggataaggtggagtgccatggtgtcttatacacatcctccatctttattagccaactgtgaacttagcaccagccctgggcatctcaggcgtgtcctctgtcaaaaggagacttcattcacctgggcattccttcagtctctggggcaggttttggctcctttctccatttgaaattatttgacttggtatccaattttaagtttaaagctttcttttcattgactctttcagaaaagccatcggatccctttgcgaaaggaaaaacttctagtggctcaactgagcatacttggtttcttcccaatagcacgtttatgagagtgtcttcctgagagcttcatgataaatactatcatcaaatagtagccaaggactaaggtccaattcaaactctacccttccaccaactggcccacatgagcatatgttcctggtacagcactaaccttagaacaatcatttatctaaccatttatctctctttccatttcctggccataagagtatgagaagtcatgctatatttttaggaaatgttacaaatatatttattagactaaggaagttcttgaataaagccatcacaacttatgttggatgaaaatgtaagagaacatgtcaaatatatcaagttcaatacacttttagttttgttttgtttcattctttttccagataaatgaaaatttagaaatttattacatcagagctacaattcaagggcctgtggaagataacttttcccaccaagtgcttatttcagtcaaatgtacatgaccataacattatactttaaaaggccaaagaaaaaataacttaatttcctcgtaccagtatttttcaatatggggtcagtgcagcaaaattcattgggtatctggctaagtgccaattcctggtcttattccaggcatatcaaagcagaatttctggaatggaggcttaagaaccttagattttgtttcccttagttaatcttattgaccattattcactgctctagcatctcccctcatgttgcaggctcagaggaactgcatacaaaactcaagtgccagaaacaatggaagctgacctggtatcaatgcttctcctaaaatgtgggaagatttctgccccactctaggcccttctgtctttccaacactttctgtaaaattcacgtaagtcaggagaatttctgagtagattaactatgacacaaaagacttctaggtggccgaacctaccatagaataaatgattttatgaaacattttatgaatgatctcaaacacccctgctgatcctctctaggaatgaaaatgaagggatgataagaatttaaccagtagtcctgagagaaccactgctgacagagagatgcagggtggaagagaggttagataaaattttaaaaacacctgcctgactctgtggaaggaacagcaagtcacttctaatccctggagttatgctgcctcatagggaagtagagttggattttaaatgagaattttatgagacattcttgatctcatatattctatactaggacccctttattgtactaaggcctattaggtcatgggtaccaattatttgtttagaaaacatcaccacagtaattacaagagatccttgagctctttgatttgttcgggctttgttttagagggatgcgaggcaagaacattattgtaattccttaagtgagaaatcctgcctttcttctatgcatctagtttccaatcccattgtaaggatgtgaaataatcaaaatcaacagcacctttgattagtcactcatttatccttgaattcactcatttgccaaattcttattgattacctcctatatggatcacaaaaattctcctcattgttggggaaaaaaatgtaaccaacaggtgcagtccctgcctacatggagcgtatggtctgaagagggagtatataagtaaataggcaaatttaatatggaatgagtgctatgataggattaagtctcaatgaaagggagccaactatgagaacaaagaaagggagagctagagacaggagacttgtcaggggtctttggcaaccatccaggtgagagtggcaccagtgagcatgaagaaccattgatttcctttgatgtttttttgctcatttttctttctaaatattggagattaggcagagcctaatcactcacctctgttaatggcttctaaccaattaatcagtgtacataagccagatgtgaaccaaaatacatcatgcgctagtaaagctgggcttcctctctttcactccagtttgaacttatccactcagctctagggcaggcagtcaaaaacagaaggagtcttctaaagaggagtcacatccaaccctgtattatggccacagttttccatgccccctgtgttcatgcaccttggttgtgtcctcatagaagactctgggcttggccttacattctgcattgaccaacaggatgtgcaggaaatgacattggatctgcacgcagccgcaggaagacttgtgctcttttttttaacactcctttgaaacctcaggtactttgtaaagaagcctgggctacattggtggaggataagaaaccaagaggaaaagagccaagttgtcctatccaaggtcatcccaaccatgtgaaacagtccagccaagatgagaagaggtgtttaccacagttggcaaccaatgtatcagtgagcagagatgaaatcagaagatccatctacttgacccatatacttgtgaatgataaatgctattgttttaagccactgagttttgatgtggtttgtcacacagcaatatctagatgatatatttcctgagatctaagagattcaagatacagagacaagacaaagaagaactggtactgctattttatgactgtaactttgtggcttatattactatggccaagttcccataaggttctctctggtttaatcaaccatcaaaaagaataaaagaaatcagagagagagaggtcacatatttcctctgacacttcttgagccaggatctgaaaaaagtcttacctggaggaagaacttctttcttctgtgtacctaagtcattcaccaccataattgcattcttagtctccttgtgaataacccattaactcagataaaccactctttagtgaatataataaactcatttaagagctgtgcattggctaggacaaaaagaaaaaaaataacaataacacagaaagttaaccaaagcttaactaacagacttttcatcttatttctttatttctctcctaaaacagtacccatgcttgagtgtaacaaaatatatgtaaaaacaagctgtcaggcttctgacacagtagatgcctagaggcaaatatttctgctaaaagttttgatggagccctggggagaggaggaaagggtcccaagctgagagggattggcagctggctgggagcgcaacctgacgctcccttcccatttcacaaagaaggttttgtttggattgtggggcatggtgagtgactccttagcaccatggggttatgctgggtcctgggggaacatctgggctgccatttcaagcaaggctgaaactctatcctggccagagctgctccaatgaatcaggtgtaggtgtatttttccaggatgttcaaaaccacatcttacccagagaaacagggttttgtccatagaagcctcattctaaagggcaagcaatcttccttggtccccatgaagggtatgtttactgaggcttcatgcccaaagaatcaaatccaataactgaaagtatgacctccacacatgcttttcaaagtatgttaggaaccctcaccaataaaatctctattctcactccatgccattcccaccttgtgtttataacacagtttcaaaagatcgatccctcatttggagctgaaaggttgcattttttttattttaagttctgggatacaagtgaagaacatgtatgtttgttacatagatatacatgtgccatggtggtttgctgtgcctatcaacccatcatcttggtttttaagccccacttgcattagctatttgtcctaatgctctccctcccctcgccctccacctcccaactggccccagtgtgtgttgttcccctccctatgtccatgtgttctcattattcaactccaacttatgagtgagaacatgcagtgtttggttttttatttctatattagtttgctgaagatgatgacattcagcttcatccatgtccctgcaaaagacatgatctcattcttttttatggctgcatagtatttcatggtgtatatgtaccacattttctttatccgatctatcactgatgggcatttgggtccgttccgtgtctttgctattgtaaatagtgctgcaataaatatacatatgcaagtgtctttatagtagaaagatttatattcctttgggtaaatacacagtaaagggattgctgggtcaaatggtatttctgattctagatccttgaggaattgtcacaccatcttccacaatggttgaactaatttacattcccaccaaaagtgtaaaagcattcctatttctccacagcctcaccagcagctattgtttcttgactttttaataatcaccattctgaccggcatgagatggtatctcatcatggttttgatttgcatttctctaatatcagttatgttgagctttttttcatatgtttgtcggctgcataaatgtcttcttttgagaaatgtctgttcatatcctttgcccattttttgatggggttgtttgttttttctcgtaaatttgtttgattctggatactagacctttgtcagaggggtagattgcaaaatttttctcccattctgtaggttgcatgttcactctgatgctagtttcttttgctgtgcagaagctctttagtttaattagatcccatttgtcaattttcgcttttgttgcaattgcttttggcatcttcgtcatgaaatctttgcccatgcctatgtcctgaatggtattgcctaggttttcttctagggtttttatggctttggtttttacatttatgtctctaatccatcttgagttaatttttgtataaggtgtgaggaaggggtccagtttcagttttctgaatatggctagccagttttcccagcaccatttattaaatagggaattttttccccattgcttgtttaccaaagatcagatggttgtagatgtgtggtgttatttctgaggtctctgttctgttacattggtctatatgcctgttttggtatcagtaccatgctgttttggttattgtagtcttgtggcatagtttgaagtcaggtagcttgatgcctccagctttgttctttttgcttagaattgtcttggctatacatgctcttttttggtcccctgtgaaatttaaagtagttttttataattctgtgaagactgtcaatggtagtttgatgggaatagcattgaatctataaattactttggccagtatggccattttcatgatattgcttcttcctagttatgaggatggaatgtttttccatttgtttgtgtcctctcttattttcttgagcagtggtttccagctctccttgaagaggtccttcacatctcttgttagctctattcctaggtattttattctctttgtggcaatcgtgaatgggagttcactcacgatttggctctctgcttgtctattgttggtgaataggtatccttgtgatttttgcacattgattttgtatcctgagactacactgaagctgcttatcagcttaaggagttttttggctgagactatggagttttctaaatatagaaacaggtcatctgcaaatagagacaatttgacttcctctcttcctatttaaacactttttctcttgccttattggcctggccagaacttccaatactatgttgaataggagtagtgagagaggttatccttgtcttgtgccagttttttaagggaatgcttccagctcttgcccattcagtatgatattggctgtgggttgccataaatagctcttattattttgagatatattccatcaatacttagtttattgagagcttttaacatgaagccatgttgaattttattgaaggccttttctgcatctattgagatgattatggggtttttgtcactggttctgtttatgtgatggattacatttattgatttgcatatattgaaccagccttgcatcccagggatgaagccaacttgattatggtgaataagctttttgatgtggtggtagattcagtttgccagtattttattgaggatttttgcatcaatgttcatcagggatattggcctgaagtgttcatttttgttgttgtgtctctgccaggttttggtatcaggatgaagctggcctcataaaatgagttagggaagattccttctttttctattgattggatagtttcagaagaaatggtaccagtttctctttgtacctctggctgaattcaactgtgaatctctctggtcctgggcttttctttagttggtaggatattaattactgcctcaatttcagaacttgttatttgtctattcaggtatttgacttcttcctggtttagtgtgggagggtgtatgtgtccatgaatgtatctatttcttctagattttctagtttatttgcatagaggtgtttatagtattctctgattgtagtttgtatttctatggtgtcagtggcgatatcccctttatcattgtttattgtgtttatttgattcttctctcttttcttgtttattagtctagctagcaatctatctattttgttaattttttcaaaaaaccaacttcagggttcatttattttttgaaggattttttgtgtctctgtctccttcggttctgctctaatcttagctatttcttgtcttctgctagcttttggatttgtttgctcttgcttctctagctcttttaattgtaatgttagggaattgatttgagatagttctagctttcttatgtgagcatttaatgctacaaatttccctcttaacactgctttagctctgtcccagagattctggtatgttgtctctttgttctcattgatttcaaagaacttcttgatttcctccttaatttcatcatttacctaggagtcattcaggagcaggttgttcaatttccatgtagttgtgtggttttgagtgagtttctcaatccgagttctaattttactgcactgtggtctgagagattgtttgttatgatttcagttcttttgcatttgctaaggagtgttttacttccaattatgtggtcaattttagaataagtgccatgtggcactgagaagaaagtatattctgttgactttgggtggagaggtctgtagaaatctactaggttcacttgatccagagctgagttcaagtcctgaatatcttcgttaattttctctcttgttgatctgtctaatattgacagtggggtgtaaaagtctcccactattattgtgtgagagtctaagtctctttgtaggtctctaagaatttgctttatgaatctgggttctcctgaattgagtgtatgcatatttaggatagttagctatttttgttgaattgatccctttaccattatataatgctcttctttgtcttttttgatctttgttggttaaagtctgttttgtcagagactaggattacaacccctgcttttttttttttgctttccacttgcttggtatattttccttcatctctttattttgagcctatgtgtatctttgcacatgagatgggtctcctgaatacaacacactgatgggtcttcactctttatctaattttccagtctgtgtcttttaattggggcatttatcccatttacatttcaggttaatattgttatgtgtgaacttgattctgtcatcatgatgctatctggttattttgcacactagttgatgcattttcttcatgctgttgttggtctttatattttggtgtgttttttcagtggctgctaccagcttttcctttccatatttagtgcttccttcaggagctctcgcaaggcaggcctggtggtgacaaaattccttagcatttgtttatctggagaagattttatttttcctttgcttatgaagcttagtttggttgaatatgaaattctgggttgaaaattcttttctttaagaattttgaatattggccaccactcacttctgacttagagtttctgctgagatgtctgcagttagtctgatgggcttccctttgtaggttacctggcctttctctctggctgcccttaacattttttccttcatttcaaccttggaaaatctgaggattaggtttcttggggttgatcttctcgtggagtatcttagtggtgttctctgtatttcctgaagttgaatttggcctatcttgctatgttggggaagttcttctggaaaatatcctgaagtatgttttccaacttggtttcattctccccatctctttcaggtactataatcaatcataggttcggtctttttacatagtctcatacttcttggaggttttgttagttccttttcatttttttttctctaatcttatctgcatgccttatttcagccagatggttttcaaactctgatactctttcttccagttggtcgattcagctatgcttcacgaagttcttgtgctctgtatttcagctccatcagttcatttatgttcctctctaacttggttattctagttagcagctcctgtatccttttatcaaggtttttagcttctttgcattgggttagagcatgttatttcagctcagtggagtctgttattacacagcttctgaagcctccttctgttaattcatctatctcatcttccgtccagttttacgtccttgctgtagaggcattgtgatcatttggaggaaaagaggcactctggccttttgggttttcagtgtttttttcgttgattctttctcagctttatgagtttgtctagtatcaatttttgtggctgctgactcttggatgaagtttttgtggggactttttttgttgaggctgttgttgctttctgtttgttttacttgcaatgtgcaggtccctcttctgtagggctgctgttgttcgctgggggttcacttcagatgctattcatctggctcattcctgcactgggagatgccacaggagaaggttggagaacagcaaagatgattgcccgctccttcctctgggatctctgacctcaaggggcaccaacatgatgctagtaggaatgcttttgtatagggtgtctgaccacccctcttggagggtctcacccagttgggtggcatggggagcaagacctgcttaatgtagcactttgtccctccatggaaggggtgtgctttgctggggggaaacccactcgtctgggctccctggattcctcagaactagcagaaggaaagactaagtctgctggtctgtggagattgctgccacctcttcccctaggggctcaggcccagggagatcagagttctgtccctgagtccctggctgaagttgttaaagttcctgcagggagtccatgctcagtgaggagggatgagtcaggtttagggcctgaagaggcactctgtctgcagtctgccacagctagtgtgttgggctttgggggatacctcttggtactaagcggtccagcctccctggctccagcaggggaaaagcggggcctggagctttagaaatgtctgccgcccttcccctaccctgggagcttagtgtgttaggcagctatcagtctcagtgttggctgttgcccctccctgaaggagctcaaatggcttacacagcaagcagccacagctgtggtgctggtcacccctccccactgggaccttggcaagcttaagcagattctagctgagtcgctgttgagaatctgcatggctccgtggctgggaccctaggccctggtggcatgagctcatgagtgtgatcttctgatccatggattgcacagttctgtggaaaaacctgttttcccaggctaggtagcatgctcactcactgcctctcttgcctgggggctgactgctcccctgccccatgtggctgtcagatgatccactacaccacactggtcttctttcctctctgtggataatgccagccgcttagtcagttctgatgagagaacctggatacctcggttgctggtgcaggatttgcagaccattacggttcttttcaatgggagcctctgatcgcattgcttctagtccgccatcttggccccatccctgtgaactgcatttttaaacacctgtttttttctactccaaggacattttccttaacattgtcagattctccacttcttatgccactttgacattgttctattgctaatagtaacacttctattcttatcagtatatgcatttaaaaatcccttaatatttaaaaaatttttacatggatgagcttaacttgatgctgttgatgaatctgaaaaaacttaaatgttatttctgtattctgtgacatcttaaggttggtagagaaagtgtggttggtaaagaaagtgttttattttattgtaaatttggtaactgattcacagattgagattgatctaggaccacattccggagtcttaatgtgagtcattaagagtggtttattggtggctggaagattggcagcccagggggaaagggccaggacagctgccatggggaagagcaacaaagaggacgatggggagatatcatgtagaatatggacctgcactcatcagcaaagagctccagccagatcttggaatagcaggctaaacacagaccaaagacacagtaactaattgagccttcctgcaaagtataataattgatgtaaaacttgtttaggagtggcaatttatgggaaataccaacataaaactaatttttacaaaacatggaatatggaggtcagattataacatttattggtgaactgattccaattattaacaaaattagaagctcctaggtgtatgcacatctgagtaggtcaattaacatcatacttacctcgtaacctactgtattagatgtctgctatttgctgcccccacatttagttctcttcaagtaatcatagtgtcctgattctactttggggattaacctcttttccattcccgctttcgtaattagatagcgagggactccagcctcaaatgtagatgtgggcttatactggcttaagtcaataagattaatttttttattgttttgtcttgttttaattttttttgagacacagtcttgttctgttgcccaggctggagtggagtggcatgatctctcctcactgcaacctccccctaccaggctcaagccattcccccacctcagcctcccaagtagctgaggacacaggttcacaccaccactaccagctaatttttgtattttttgtagaggcggggtttcaccatgttgcccaaactgatctcaaactcctgagctcagcctcccaaagttctggcattacaggtgtgagctgccacacttggtccagatttttttttttttaatcactgtgattggctcaaagttggagatataacaaaatcactaccaatgaagttctaaggggatatttcatgtgacttctggcaggaaaggacatttcattcacccttccaacaaatattttctgaacaagctgggtgcccagtcatggctaggattaagagatattaatggaaagaaagcacactctctaccctcaaggtactctcaacggaggacacagaactatgagtaaataattagaataactagtgctgtatctggggtatcgatggattgcaataaaagcaaaaagtgagggattatccttagtgttcatgtttgaagaaaagctagatgggaaatcacttcaatatgtagagacatcagcagaaatttccaaaaggatatggtgtgaggcttagggttttctggattcctattggcttcagacactttcttcctggatcttctgatttgtcagatagcttgtgtctgtccttgagagatctccatttctgattaggccaaatgatttattttccagaacttgatttgctaatatgcaaatgtctgggcacccacaaaagaagttgtctcatcatctgaccaatcatgcctgttcaaaagatgaataccggtttttggagccaagatggctgaataggaacagctccggtctacagctcccagcgtgagcgacgcagaagacggtgatttctgcatttccatctgaggtacccagttcatctcactagggagtgccagacagtgggcgcaggtcagtaggtgtgcgcaccatgcgcgagccgaagcagggtgaggcattgcctcacttgggaagcgcaaggggtcagggagttccctttcctagtcaaagaaaggggtgatggacggcacctggaaaatcgggtcactcccacccgaatactgcgcttttccgacgggcttaaaaacagacagccaaatcatgagtgaactcccattcacaattgcttcaaagagaataaaatacctaggaatccaacttacaagggatgtgaaggacctcttcaaggagaactacaaaccaatgctcaaggaaataaaagaggatacaaacaaatggaagaacattccatgctcatgggtaggaagaatcaatatcgtgaaaatggccatactgcccaaggtaatttacagattcaatgccatccccatcgagctaccaatgcctttcttcacagaattggaaaaaactactttaaagttcatatggaaccaaaaaagagcccgcatcaccatgtcactcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaatggtgctgggaaaactggctagccatatgtagaaagctgaaactggatcccttccttacaacttatacaaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggagggactgtaaactagttcaaccattgtggaaatcagtgtggcgattcctcagggatctagaactagaaataccatttgacccagccatcccattactgggtatatacccaaaggactataaatcatgctgctataaagacacatgcacacgtatgtttattgcggcattattcacaatagcaaggacttggaaccaacccaaatgtccaacaatgatagactggattacgaaaatgtggcacatatgcaccatggaatactatgcagccataaaaaatgatgaattcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgatagatgacgagttagtgggtgtagcacaccagcatggcacatgtatacatatgtaactaacctgcacaatgtgcacatgtaccctaaaacttaaagtataataaaaaaaattcaaaaaaaaaaaaaagacacttcatgcaacagatgtacaaatcagatactattatccccatttgacagatgaggaaatggactcttcaggcaatattaaataattttattaaagtcacaaaaccaaaaaaaaaaaaaaagatgaataccagggaggatattttaacatctgatgaaaggctactaaatagagataactataagaaataaaaatgaaaattataaagaataatcaagtaataaattaatatataaataccaaaaatctgggaagttttctgagctgacttagaactttaagaaatgctaaaacaattatgaaaagcagaagtgataatattaatgggttcggatgggtagacaataaaatcagaggtgataatattaatggtattgaatgggtagatattagaacctgaaccacaaaaagaaggtgttggaacctaagaaaacacaagttaaccaattttttttcttgattttatggtattcaacaaacatttattgaatgtctaagtgccacgaactggtaactgattccttgaactggcaatcataaactgagctggaaagtagaccactgaaagtaattttttttagtggaaaaccaaaatatcaggccaagataattacactgaactatacattaacaaagaacctttgctgatggggcacagtggctcatccctgtaatcccagcaatttatgaggccaaggcaggaggatcacttgagctcaggagttcaagcctagattgggcaacacagtgagacactgtctctacaaaaaatacaaaaattagctaggcatgagggcacatgcctgtggtccccactacttggagggctgaggcagaaggatctcttgagcctgcaggaggttgagaggctacagtgagctgtgatcctgacactgcactccagcctgggtgacaaagggaaaccctgtctcaaaaaaaataaatagataaaaaacaaaaaagaaagaaaaaagaaaaagaaaaaaagaatttttgctatctacttgagttaggcaacagatttgcattttcaataagttcctgttattgctcattagtaaattatgtcttattttttattataccatctgagtactggaaagatcacattgctatatagggaccttggcagtctctcaattttgcatgtaatatgtttagtgtgtcagagcacgcatgtacatagtatgaaactaagttcattttctatgtatttatcattaaacctcaggttttgaagtcagcaagatccaaactagcattctgcctagcttagttacttgcttaggaaagttatttatattttctgagcttctattgttttgtctcttaagatggaggagcaatacttaaccttcagttattagaatgactaaataaagtttcttcttaaaatatagaacactgtgtttgacacatagtagggcctcaatgagaatttaatgaatgagcaaataaacgaatagataaataatagaaataaaacaagacagaggaataatatgtgtctagatttatttattcatttatttcttggaaaccatttctcaccacagaaaaatgttaggtacattataggcaggatgaatagatgtcttaaaattcatgctatattcttaattctggttaatttattctaatgaaaattatacattaaaatcatcacaaaatataatttaagttgtgtgtcaagctgtactttttcatagtaatgaatttatttttcagggtatgctgtgtgcatatagtttatttacatatttagatatatttcctatttataatcagaatttgaattattgggccagtttttagctaaatagtttatagctaaattgtttcccagtaagttttctagtttttatctatgagagggccaatttgcctgcatcctctttaaattatttcttaggtcaaagggatatcttttccttaacaaaaaatgttttaatagtttacatcaaattcactgaaactatatatcatggctaatgaaacaggctttactaatttttaactacacttcaaaaaatttcttggataagatagttgggttcaattatcatacagaaaatctgtgatagtagcagcaaaattttaaaacaatagacactgatgtcccaactggcaccctaacgactatgaatctttaatacctaccattgtgttaagcttcaagaaatgaggcagagaagaggagggagaagacacagtatttcagtgattctttacaacttgacaaagtgttattatgtcatctttcaaatccataagccattattttgcaccttggggagcaatacagtagtgctccagatcccacagaatcacttatccttaaagtcttcatatacttttctcagtctatccttctctcaagggaaagcaaacttctctagctttgggaacgagtaggtcttaggtgtcagctatcacttctccagaaacaggacacaagataacaagcaaagtgacctttgcaactgtctttctcaaaggaagctgagtcatttttctctaatttggtttaaaaaaaagatgtttttattatatcgagagtaagcaccataacttctcccatggaggaagtttttcttgtgaaaataccttcaagaggcattttggcgtggatgagccggagtgtggtagattgattgcaaaaaatagcacaaacatttcccctccctgtactcatccccttgcaatatgactttgcagctcctcccctcgagacaaaactctatttgtccaccattaaatctaaactggttttgtgacttcctttggcaatagaatgtggtgaaagtgacaatctaccactccgaggctaggtctcaaaggcttcttcatgcattgtgctggctctcttgaaaccctgttctgctatgtggatcagtccaggctactctgctggaggaggtgcaacccatgacccaagcatgtgcatttccatagccagtattcagccaaccattccattgaggccattctagattagccaactcctacctgactgcgaaagtgagcaaagccagctgggatcagctgagcccaacctagagacatgcaactcacaaatagattagtgaccaacaataagggtttattttaaagtccctgaaatttggcatggtttattactcagcattaactaacagatacactcacaagcaggaatagcagtaagtatcaggatatcaaagactgtgggaagctactctacagtagcaacaggggaatcatgttggctgttgctgatagttgctcaaggtggcataaagaaaagagatgaggatgagaaggggagaagatctaacaaaatggggagtatatgtgattatatttggggggcccagggactgttaacagtgacaggacggccaaaaggtatgtaagaatgatgagttattgtgttgccagaaagtgagcatccactccactttgccttctgtgtttttaacacaatatatgtaactgattaatgcagcacaagaatagatagagatcctgtccttgtttgtgaaaactaaagagagggctgatcatttctactgggtaaagtgatgtgatacaaagatagcatgcttggacataagaccctacaatgctgagccacctggaggaatatgactctccatttccatcccctcacacggaattcacaaggaatactgaagagtgttaagacttccacagaccattgaacccattaggtgggaagaagggaggttgagtcatgtttagcttcctctccagtggaacagagatctgcagctggcatctgaatagcattcctctcatgtaaagggtggagggaatgtgtcaacaccaactgaacacctaagccttatctcatgtaattctgacaactgcacaaagaaattatttgttatccggattatgcttaaaaggaaactaagtttcagagacattaaggagcatactaaatttcactcagttggtgagtgataaacagtattttaaatccaagattgcctgaccctggcccaataatctttcgattccaccacaactgccagaaacatctatccacacatcaggtgtatccacagctgtttggtttgttgttgctgaaatttaagtataacacctcccttagcaactgaaaaggcccttagctacctgcaatatttaacaactactttctacataaatagcttctgaaggttttatcttacagcatagtgggttcatgacagcttttatctgagatgatgaaacaacaaaaatgcctggactatgacctagagcctgcccgggaggtggttggtcaggtgtagtctcttgggaagtgctggggacacagatgttccagatggttgagacatttctttcactagagcatggagtgtagaattagccaaaatacccaacctctaggaaggaaatacagatgttctaaaattgtggtatccaactcttacttttcagatttctaggattcaacagaggttcctgagaggccattgcaaatgtcagggggaaaagtaattcaattaacaacaacaacgataacaacatagcttataattgaatatcaccaggcagtgttctaagaattttgtgtaaattaacacatttaatcatgtttttatccttatgggctacatataacattatcaatagcctcattttacagatgagtaaactaagacaaagaggggttaaggaaattactcaaggttttgcagtaagtggtccaactagaattttttcacaggcagttttgtttcattgaccatgctcctactcaccataacgtactatttttcaggcagagaaagtgtttatttttttaattgcacacacacacacatacacacagacacacactcacacacacacacgcacacacacaccttacatcttcatgggattagtacattggaccagcaggactcacaggatgcaataccaaagcaacttcatttcccccgtaattgctcactcaaacctgtgccatggatcagacctttccctaaccctggatgaactcctgggcagaaaagaccacacagcttccagattccctctgaaataaccaaagaaactccaggcattttagttgcctaaaatagtgtctgttcactgatgaatatcccgagtccagtgtaatatttgaaattctgagtttcactcaaagttaaagcctgtcccttcacttgaacctgcaataggttggaaatccactgatggggaaagagggactttgtcttttctactctgttgtctccttccatcccctaccacagcctggtgttgacttcgaacctcctggttgaagccaggagagaaaagaggtggaggcttaaaaataccttaattgatgagcacccatatacagatcgtttcatattacattgcaattgtgaaggtatttcaaaatgttgtttacacttatcaatgttttaaaattatgaaaataatgatagttattaggactgatgctaaatctggttatttaatgttataaaaattttgaaatattttgataactctacttaaagaggattcctttggcaattctatggatttaatttatgtacttaaaaacagtaacctaagaaggggtcatctattgccaaagactgctgagagagtttatagcataaaagcaccttggttttgggggtttcttctccaccatataatgtctcaactgttgtcctatctcccttccagacaaccttcttgggtaaagtccctttaaggtgataagggccagttctcttcctcctgctcatatggctgacatctccatgggaaacatgcacctttaccagtgcttggcagaagtgcaggtactctgtaaccccagcagcccctactccatccgctgttcaggtctgctagttaactggtatgccctagtagggcgaactggctttgcatgtttgaagtcctcttgtaacaattggtaaataacttctgctctgagctcccgtcaaatcctctgccaatacccttgcctcctcagcctcttcccaggacctccagacctcccactattcaggaacctaaaagaaaatacttggcaaagccagaccctgcaagagctgactccaaatgcacaaatgatttcagttctcatttgtcagtgctcgggcctcactagttgttggaaccctgtgaaacatccgcactattcattacatccaaaggaagcaatctaactccctaattgggtttttccagcctctctcactagacttgaggcaaggggaccacatcccctacccaccccttcttggaatggcagtaggaaaaatactccaacacattttcccaaagaaattctctctttaatctagcacctcaatctttttatacctttcatgtggcttttgaaccttatatattgagggtccgtattaaatgttcattcactgaaattactgctgacaatcaatccctacacaccacacacacacacacacaccacacacacacacacacctaaatgtgcttggctataagaatttcccatgcagcagactattgaactacagatttttcagcattggcatttggaaaaggctcaaacctgaaggcagagaaaactaatagcctaaggcctccaatctaaagatagattctactaatcctaggctggctgccttgtacagctttgcaatgtctcctccacatgtgagcctggcccgcttgcctctcctgtttctacattctcagttccttggctggctcccccagggataactctcagtgcctgcctgatctgtgttacaaagcagacatgaatagccaggccagagagccatgtactaatttcctgggtggccaatccctctctctcatatcctagtgccattttaagggaaaagaaatgtaggacatggaataaacagagggaaacctgcttgatttgttgttaatgtgtcagtgttttgttttgtgggtttaacttgtagaaggcaggtctttgtcttgttactctctggcatttaacagggcctgccttcagtgactcagccgggtttccttagacagaaaacagccacttagtgccttttacaccaccaagaaaatgagattattccttgaggagatcagcagctctcggctgctgtcgaaagggcgctttgcctgtttgtttggctgaaaggcaccacgcagcccaggcttgtttaaaattagcttcctcataaatcacttgcacaatgaagtgtctgcctctgccctctgacatatttgtgtctctgtttatttttaatgatgacatggctttttctgtttccatttggctctttactctccacactcccaagcactaacttctgtggcaaaagtacaaaatctaagaaactgcagggaagaaagagttccttttctaccagcacataaatgtagtggggaaactgagttagccttgggggtatttctggaggaaattgcctcctttctaactttgtcagattataatatcctgaaattgtactttttgaaagagtaagagggtgatggcaatattctgtaacttgataggggtctgtgttacacacgtgtatgtgtttgcaaaactcaataaatgtatatgtaccttacatgtaagtttttacataaagaaaaaagtaaactaataatgaactctaataatatttatacagaactatttaagaagaagtatactagttttctcaatttactttgaaatgcatccaaaactgtgataaattaattgatggatagatggacagacgtgataaaacaagtagaaaaaaaatgttaaaggcaaaatatagatggtaggtacaagtctgttccctgcaaaattacttcaactttgctgcaagtttgaatatttttacaataaattattagaataaatgctctcttggtgacccacactgaatccttggaaacatcagagagccacagcttctaaaatcctgtattccacccaaattttatttttaaaaatctatatttatatagagttaaattgcaataatttatgacaacaaggaaaacagtatccttgacccagtaaaaagtacaaaatacagaatattctaagagagagggaaattttattagttagacacataagaaccttcttcaatttaaatggcatgtaactagaagttcttaatgcagctctctaatccaatatataaaacacaaatgaagaacagtaaagggcatacaatgaccaaaacccacataggatgaattcaaatgggcctggggtgagaaagtccaaccttagtgaacccacagttactgttgaaacaaacaaacaaacaaacgaatacccagaaaagtctgaaacaaggaaaaaaactggagaattcttctatgaatgctacctttttgaggcaaggtcttttctttctttctttctttctttttttttttttttctgagacagagtgtcactcagtctcccaagctggagtgcagtggctcgatctcggctcactacaacctccgcctcccgggttcaagtgattctcctgcctcagcctcccgagtagctgagactacaggcgtccgtcaccatgcctggctaatttttgtatttttagtaaagacagggtttcaccatattggccaggctggtctcgaactcctgaccttgtgatccacccgcctcagcctcgcaaagtgctgggattacaggtgtgagccatagcacccagctggtgagacaaagtatttttattttcttattacaacttttggagactttgacttccagaaaacaaccagataattagaaaagaagagctcttagcacatattgccatggtacactgaaaaattacactgctttggcaagaatgtggacaggaaaactcatggtaacagtatattgcagaggtagtagtttgttgtgcatttcttttcttcagaatggcagttggagttgaaaaagccacctctgcagcagagctcaataatatgaaagttgattattttccaatatgatattggaagttgttctagttattgtacaattaacctgtcttctggggaagggaaatatactcctcccgtggaagagagtaaggaaatgaacaataagctaataaaccttaatatctaaatgagtttcttttcacaaatgaagaccatgtacccttattgacaaacaccagctcttgataaatgtccagtttactcattcatggatgagtaaactgaaaaatattttaaaatatatttaattggctataaaatacacctacaaagtaatcttcaaagacaagtcttaaaaatgacataagaaaaagtaaaaggatcagacaaaactccaaatcatgcaaaaacagtctgcatttgaggtggtaaataaagaattaacactacttgaacttaagatgtgaacataaagtacaatttgaaaagttctcaaaaaacattgatgagaaagacaaagggagggagagaaacaggatacaaaccatagacttgaatgtattccgcaggaagtacccaaactgaaaggaaacaacaaaaataaataaataaataaagtcagagaaaaggtctgagagcacattgccaaggagtcaatagcatttcagggaagttagtgaagaggagccaagtgtggttccctgcacagcagccatgcaaaatgagttcaaaggttaagaaaatgaggattggaaagttttgttagcttgaccaaagcctagatctagaatgggatctcaggaattttattatcagaatcataaatcagaaatatcaagtctgtaatattatttgaaaatgctgaagtgccacaagtgaccattttgagactgaactcctcaaagttgtcacctctctctgaaactcattgtgctttaatattcttgccccattgccagggaacaactaaataacttcctttgctttatttcattcatccatttctccttacaagcagcattaatgttgtgctgccttattggacactttaacatagatccctgtccaaaaaaagcacaaatttcagtagtgtaggtaaacaacttcaacataacatatggagtacagagggagagagagaaaaaacatgagagtctgcaagaaattatcatttgtgttttatagtattttttctcttatagtttacccacatatttatcattttcatagttctttttgcttcttacatgtcttacctttcatccgggaatattttataattcccattggtagcatctgctagtgttaaactgtctttgttgattttgatgataaaatgactttattttacttttattcttgaaagttatttatctgggcattaaactacaggacgggagttttttgttgttgttttccttttttttttttagcacattgtatctattttttgtttccattgtaattgagaagtcaactgtcagtaaatgctatttgtttgaaagtaatctctcctcttttctctgcctcctcttaaaatttttctctttgtactgggttctctttagaatcactatgatatgcctgaaagattttttaatatcatttgatatttttgggttttctgaatgtgtgaattagtgtctttcatcagctatgaaatcttttacacccttacctcttcaaacattacgtctgcttcactttctctcttcttttgctttcggtgtttttatttcttatatgttagaatctctatatgtctccgccatatttgtactgttcaatatattagtccctagccacatgggggtatataaagttaaacttaactaagtaaaattaaataaaatttaacagtcagtttttcaatctcaatagccacatatcaagtacccaacagctgcatgtgtatagtggctactgaattggacagcacagatacagaatgtttttattattgcagaaatttctattgcactgatctatatctgttaggtgttctggtatattttcaatctttcgtttattcttcatttctgatttttcttagatttttgaccaatctttttgttcaatagttctctatcaactcttcctaatttgctgttaatttgatctttttagttattttactttaattctagaatgtatattttgttaattttttaatctatgatatcacattttatggttgctggttccctgccaacattttaaatcttgactttcatctcattgtatatagtgagcacagttgttacatagtctgcctggtaattctattttttggacttcattgtgtttgctcctatactgtattatttttgctgtttttttttttcttatggtatttcaactcttcatgtattcagttatttctgagtatgtgctggacattgtttctaaaaactaactttcagtaataaattcaagacttgattaaagttgtcttccaccaacaaatatattcattgcttttgccagaatcctgggcacactatttttgaccatttaatacaggttcatgctttaggttttctgtagagtagaatgatgcaaaactgtcatcttaactaccagacttcaacccttaaagtttcagtccaaagtgttagtgtcctctcaagatcctcctcccaaatgtacagaagctgctaatgacagaaaagaagaaatatataggaaacatcaaacaatggagaaaagtatcaaaaacaaaagctcattcttcagaattattaataaaacagtcccttgagagactggccaaagaaagagaaggcacaagttgaactataaaaacttgcacaaataagaaataaaagaaattgatttaaaatcttgacatagtcaagaaatacaataaattgataatatattaaaattttataataaaaataacattgaattatgaaataatagaaactacaaaatgccaataattaattaatctataccttttcaccctataaaatagttttataaagggctaactacactttcaaaaaacaaaaattcttattttctaaaaccattgtacataatataaagaaatgtcctttaacaaattttctgaaaataatgtagcctttatatcaaaaaccagaaaaaagacagcataagaaagtatatattagtcaatattaggtagaaacatggatgaaaatatcagttattaacaaaatacttctcatatccatcaaactcacataaattaaatttctagcaactcccagtgccactgaagttatagggtatctggaacattcatctattcccaataggagtttaaacagtacaaccatttttgggagtgatttggaaatatccactagagtaatgcccagtaatagtggaatggattgataacttgtgtgtattaatataatggcatactatatacctgttaccatttatgcacaatttctttttgactcaacatacacacatttcaaaaatgcaaaatcaagtaaataaaccaaggtgccgaagaacattaaaaaattatactatttgtgcaaatttaaaaaacacacaagacacaatacaatatgctgtgtgtgtgtgtgtagatatatagagcatatttatacatcaactgtagaaaggcaattgtctcctgggaaggagactaggaaaggagatcaagaagggatacaatggggacatgaagtctgtctgaaaagaaatatttaaaaatgatttgaagcaaccaaggctcaatataagcattttaatatttaggtagacagtgtttattaggtataatattagaccttactttataaagtaactgtgaggactaagtgaattaatgcatataaaaggcttaaaggacagagtaggtgctcattacatgctgattttcataattgttactcattagagatggtgaatttctagacagaaaagcccagctattatttatcactgtcccttatgcatactacaggatctagcacagaggagatgctcagtaatttggttgaatgtgtccacacatcataaattgctgtcttcatctcaaactccctaatggtccttgcctacttgcatggatgtaggtgaatgaggagtgtaacagattggcataaaccactggtagaaacgttagggcttagtatttgactcttacaaccagttccatatgtgacctggtttatggtttcagggcaagtgattacttttaagtaaccaaccagcagagtttagacgtgtttcgagattcttggaagaaggttgattacataaatgccaactatattagtattgatttctcaaagaataaaaagaaaaaccaaaaaaaaggtcaactcaatcagctatttattatttcttctgttctttaaaattgtaagaatttctgaggggtgggaatttcaaagctatttcaagatcattatataaagcattctttagtatataaggtcttaaggaggagaaatgggctttggctgacttcacccacaagctgaactccataaatattatatagttaacacacgatccagatactttaacttcacagagttcaggaaagaacagcttttgtttatggtgagttttcctatgtgttgaatataaagtaccaattaaagtgtaatcggaatagctgtttgaatttttggcagcgtatcagaaggagttacggaaagcagggccttttcaatgatagatatgattttgcagaggtcatgctatggcctggatagggcatgcctggcctgatttcaaaccataaatgcatgcgaatgtaaggaaatgaatcctattccagggcctatatcttcattgccttagaaatggtttttctatttccaaagcaattctggttttcagaataatttgcctggaactcaatccctatatgctgatgagaccaactgaggtctagaatggctaagacactggggcattttattttgttatttccactgtccaattctttgtagattttgatttggaaaagtattcaacccattggaacctaaaccattctccctctccctaaaatattttcatagaactgagttccccttattttcagagttcttacatcaattatacatgaagtgaatgcctgaaaggatcaggactgattgtggggaagaagtgaagtatgttacggaataaaagactggaaacagaaaataagtagaaaacagaaaaagcaatgaagcaaacatgcatggttgacataaacgtggagcagaaactacaacaataggttcttggatagtgcctctgaatgggacaaatagtcactctggagtctcagtaaaaatctaaagagagaaacctgatccaagttaaaggtatagtcagcgactagctcaacttctaacagcttccaaaaaccaaaaatgtgcagttgaccttgtaactaggattgcatatggcacccagccaaaacccgccagccctctccagggcaaagagtgacagctttgctgtcctgcagttgaaacaagtgggagctcatattaaactgtgccaagcagggcctgccactaagctgaacacctgtaattcacccatctgtgtccctcaagtcctcaccccaaagtaaattgattctgagctctaacagctgtctgggggactctgctgggctgttcccagcaggaaaggatgtgggagatgataaaagctgtaggtgtgtttccaaggtcagaacccaaagagggaagtttttttgattctttcatttgtagagatgacaaaagtggtagtgggtgggatgcataatttccagatcatttaagtaactaccagacgttgtttatcccatcatatgatttgaaaattaagataatcatagttgatgaaagaggagaaagcctgggcaatgagggtccctttcatcaaggagtgtaaagcaaagagtaggagaaatggggtacaaacttagaaaatgaaagtcatatgcagtgtctctgtaaaggtaagagaatttcaggaatattttaaacatacattcagtgtagactaccctgttcatatcaatgatagaaaaatagatatgtaagttttatgagcaacaaattcaagtttggaagaaagaaacatacacatatggtcacctgctatgggtatttataatattagatgtaaagtgtttataacagcagactcttgccaacatcagcagccattgacataaatagattaccgtagattactagaaataaatgaaacccttgtattctatataggtgatattccaaaagtaaacagaatcttaaaggctgaatagcccaggctcccttgtgacttgagccatagccacactttttttttttgcaagcttacatactattttgtttctggaattttttaaatgcttttgagtaaagagccttgtttattgttcagataactgttttatctgctattactaaatagggaatcttcatttattcattaccagtcacacatttattaattttgtttaaaactatttattgtcctggtccttgggatatagtgataagtaagagcattagtctctgcttgcaggctcatactcaacaagtggtgactttcaatgtacttttgtgtttatgcacacatgggaaaactagaagcaatagattgcgtctaaagcaaaatgctaagaaaagagcttctaactgaaggcatctctatgagaagtttgactgaattcagctgatttccataatcacaaacacctactgaataactacctatgctttgtctttggtgagccacaaaagtgctgagattcattcatagggccccattctaaatgggatcagcctagtgggaaaagactctgcagtcctcttagaatgtgccatcaatttttccttcatctgtgtgcaattgagttgtccagcacatacatttaagtgcctataagatattaactacattgctaggcagtgggaataaagagtgctgttagtctctgtccattcatctgcacatctatcctttcacccattcatccaattcagatatttaatgaatgatgatcatgtactaagtgtttatgctagactgtggagaaaaaataaaacaacatagacacactttatgacctcatggagcttacattacagaagcagacataaacaaaacataagaaaaacaactagatatacatgaaattgacaaattctggtatttggagagatttctatttttagaactataaatctcaagaagttctgagagaccctcctgctataaaatgaacagtctatgaaggcaaatattttagagaaaatgctgattccacaattattaggaaagatgccagaggcaccccccagtttccctcccctacacacagacacagacacacacacacacacacacacacacacacacacacacacacacagcaaacaaacaagaaataaaggaaccaacaacaaatatgagttggtcctagaacagctttgaaatgaggaatctaaaggtaccagaatcagaatgctgggggttgatattgccgaggctgggcagctggatttaaaaatattttataacttttcgtaatttttctctacatggcctagtaaagagaagaatgccctgggcattctgttgataccccacaaggacgactactcaagaattagggtttgagatgattcagctcttacaaagactgatcttcgtgaatggactgtttgctctctgcttggattaaggtgatttttccctaacctaaatgcctaccaggtacacaattagatcttctctagaagaatataaagccatgcagagccttaattattacactttttcaaactcaatatccattatttaataaaatataattactgggcatatagggatagaaggacaaataactaatgatcaagacagagagagagaaagaaagagactagaagcagaccaataggagagccaaatattggaattaatagataacaaatttaaaaatgattatgatcaataaatacaggaaattaattggtaagattgatgcacaaaatacacataggacatggtgaaaatgtcagacactcttgaatccagttggagttccagaaaaggaggagatgcaacacatgacaaagcagtaagaaaaaaaaaacaaacaaaaaacactctcaacaaacacacaaacacacacacattttaaagtgtacattgaatacttaccaaaatagattataaaatctttctcaattttttaaaaattgagatcttagagcacgttctttagccacaataaaattaaactaaaaatcaataacagaaagctttccagaaaatactcaaatatgtttttccatttgtttgtgtcctctcttatttccttgagcagtgttttgcagtcctccttgaacaggtccttcacatcccttgtaagctgcattcctaggtattttattctctttgtagcaattgtgaatgggagttcattcatgatttggctctctgcttgtctattattggtgtataggaatacttgtgatttttgcacactgattctgtatcctgagactttgctgaagtttcttatcagcttaaggagatttttggttgagatgatagggttttctaaatacaaaatcatgtcatcttcaaacagaaaatttgacttcctatttgtatagcctgtatttctttctcttgcctgattgtctcgcccagaacttccaatactatgttgaataggagtgatgagagagagcatcctgtcttatgacggttttcaaagggagtgcttccagcttttgcctattcagtatatgatattggctaaaatattacatcctcatggataggaagaatcaatatggtgaaaatggccatactgcctaaagtaatttatagattcaacgctattcccatcaaactaccactgacattcttcacagaattagaaaatactgctttaaatttcatatggaatgaaaaaagagccaatatagccaagacaatcctaagcaaaaagaacaaagctggaggcatcatgctacctgactttaaactacactgcaaggctacagtaaccaaaacagcatgatactggtatcaaaacagatatatagaccaaggaaacagaacagagacctcagaaataacaccacacatctacaaccatctgatctttgacaaacctgacaaaaacaaggaatggggaaagaattccctatttaatcaatggtactgggaaaactggctagccatatgcagaaaactgaaactggagggcttccttacaccttttacaaaaattaacccaagatggattaaagacttaaatgtaaaacccaaaaccatacaaaccctagaagaaaacctaggcaataccattcaggacataggcatgggcaaagactacatgacaaaaacaccaaaagcaattgcaacaaaagccaaaattgacaaatgggatctaattaaagagcttctgcacagcaaaataaactagcatcagagtgaacaggcagcctacagaatgggagaaaatgtttgcaatctacccgtctaacaaaggtctaatatccagaatctacaaggaacttacacaaatttataagaaaaaaaacaaacaatcccatttaaaagtgggcagaaggtatggacagacacttctcaaaagaagacatttattcagtcgatgaacatgaaaaaagctcaacataacggatcatttgagcaatgcaaatcaaaaccacagtgagatacaatctcaagccagtcagaatggtgattattaaaaagtcaagaaacaatagatgctggtgaggctgtggagaaataggaaaacacctttacacttttggtgggaatagaaattagtccaaccattgtggaagacagtgtggcaagtcctcaatgatcaagaaccagaaataccatttgacccagcaattccattaatgggtgtatatccaaaggaatataaattattctactataaagacacatgtacatgtatgtttactgcagcattatttacaatagcaaagacatcaaatgacaatcagagatagtctggataaagataatgtgatatatatatatatatatatatatatatatatcatggaatactgtgaatatttggaatataaattattctactataaagacacatgtacatatatgtttattgcagcactatttacaatagcaaagacccaaatgcccatcaatgatagactggataaagataatgtggtacatatacaccatggaatactacacagccataaaaaagaatgagatcatgtcctttgcaaggagatggatgaagccggaagccatcatcttcagcaaactaacacagaaacagaaaaccaaacattacatgttctcactcataagtgggagttgaacagtgagaacacacaggataaaacaaggaagattaaaatatattttaaactgaataataacaaagacacatcatttcaaatgctcacagaacatccaccaatatagattatatattatatataatgagttcataacaattctcagtaagtttaaaatatttgaaattttacatagtatgttctctaacacaacagtattaaaaaattaatagcacagagatttctgaaaaaatcactaaatatttgaaatgtaaatattatacttctaaatacatggttcaagtaaaaagcagcataaaacataacatatattttgaattaaatgatactgaaaacacagaatgacaaaatttgtgggatgtaactaaatctgtactagagggaaattcatagcttcaacttcttatactagcaaagaaaaaaaaggattttaatttcagtgatctggttaagtgttaagaaacatctagaggttacaacactcttcatggtgaaatataagggcatacccctctaaccacctacatgcaacgtaatcctggagagcctatccatgagactccacatagaaaactctaaaaaaatttttttaaatactaaaacctacaagtgaatttagtgacattgtaggatacaaagtcaatacacacaaatcaatagtattttacataatagctgaggacacatggaaacaaaatttaagaccacaccagtcacaatagcttcaagaagaatgtaatattgagaagaaaattgacaaaatatgtgcaaaccctatatactgaaaaacactaaataaatcttggtggatattaaggctaaatttttttagatgccagttttactcaagttgatctagagattcaacacaatcccattcaaaatctccacatggctattttacagatatttaaaattttattttttaatttatatggaaagttaaagaatagccaaagcactgttgtaaaagaataacaaagttggagagctacttaatacattatttgatttctagatttactataaaaatagttatcaagatggcatgatattgatgtaagcatagatatgtaaatcaatagaagaatagtgagcccagaaatatattaacacatgtgagctaaacagatttttgacaatgataccaaggtgatttaatgggggaaatgatagttgttcaaaaaatggtgctgaaataacatccacatgaaaataaatctcaaattttacttcatcctctgtgtaaaatcactcaaaatggatcatatacctatataaaacctaaaactacaaaagttttaaaagagaatacaagataaaatctttaagtacttgaatttggcaaaaatttctttgatagaaaatggtttacgctaactataaaagaaaataaaatgataaactggacttataaaaattagacttcttttcagaaagtgccattgaaagataatgaaaaggcaaaggtacagactggaagaaaatgtctgtaacatatatatctgagaaagacagagtgaggagtacaaaaaattaactggggaggagagacatgctagagaacaagaatttgctgaacactttttatgtatctgatactgtacttaactttgtttttaaagataaactattggagcttagagaagctttcccaaagtgtgacaactaaggtattcagtctttccttccattctttaacagatgagtctcccttggtcttactaaaatattactaataagggaacaagttggtcctttagtgtttttttaaggaagactagaggataggaagctgggcatggctacatgtgagatcacgaagacacttatagaaatccttttccttcttattctgtccctgaaaccatatgcatttatagtggtttttattcttcctgatttattttgaggtctaccctaagctgtaagccctaggataagtctattcaatctataaaatctaactagagttggtaattttttttttttgagaccaagtatcactctatcgcccaggctggagtgcagcaacgtgatctcggttcactgcaacctctgcctctggggttcaaatgattctcctgcctcagcctcctgagtagctgggattacagtgcctggcaccactcctgactaacttttgtatttttagtagagacaggttttagccatgttggccaggctgtacagccaataatttaatactagataatgtttaaccactatatttgaattttaccattaatttccacttttcccttttaaatctaaggtgtgactccataacaatagatttcagtcttgtctttcatccttgctactggaagtgtgaaccatggcccaatagcattggcatcacctgggagcttattagaaatgggaaagtcaggacccaccctacacctacttcatcagaatcttcagtttaattaggtctcagcttattcaaatacacattaaaatttgggaaccctgctgtttatgaccacatagaaaaacaggaaacaggattgcttcctgctcctgtaactacaaaggtatgaaagcacatccttgggatgtctagactatagtctaccactctactggactttactgcttgcggaccatgtagaaaactttagacaggtcgtttagcatctctcagtctcaatttcctaactataaacaggatgagtacattgtcttcatagacttgctgtgaggattaaatgagataacattcataaaatacccaaggcaaatgctgacacggtgttggttttcaatatatgcagtcttttcaagtggtcaataaagaatgattctattttgcatgaaataaataacaaaagtcagtgccttaaagccaatgcaaacccttgacatttcctcacatcaaggagcaggatcatttgcctctttctctatgtgttatttttttctttgtgcaatggtctcagtctatgagtgggggcaggcagtgctaggaagagccattgccttttagattgtgacctccccccatccatgtccccaaacggcctacttaataacaagagcagtaacggggttcattatgcatgcagctctgcaatcattgctgaggagaaaattagtttgatgccctgagcgacagttgaactctagaaagtgcctaaataaaataaaagacaaggaaaatatatacatacacataaatataataaagagtgcagtgagaaaagttatgaagaggccaatttcaaaacttgcccttttcctggtgcttcttgattttttaggaatggtgtgttggttactaaaaagtctgtttatttaaccaaaagttgccttgtctctagcattgtgcaggtccatgggaggtctgggaggctcaagcatgtacacacatgcatatcttaaaacaacacagatgaatctggaagccatcatcctcagcaaactaacacaggaacagaaaacaaaacacctcatgttctcactcataagtgggagttgaacaatgagaacacatggacacagggaggggaacaacacacaccaaggccagtagggggatgggggctgatgggaggaagagcattagggcaaacagccaatgcatgcgaggctttaaacctagatgatgggttgataagtgcagcaaaccaccatggctcacctatgcctacataacaaacctacacgttctgcacttgtataccggaattaaataataataatcatcatcataatcgtaggttgccttctatgaattgttaaaaaaaagattgttttgccattatttttggtttacagaagagttgcaaaggaagtgtagtgttgtcatacagccttcacctagcttctaatgttaacatcttctataaccacagtaaatttatcaaaactaagacattaacattcatgtacactattaactaagtgtaataggcattctttggatctcccctctttggtttttctggacctggatctaatccaagacatattgcatttagtaatgtatgcttagtcttctccagtctagaagagtttctgtctttccttgaatttcatgaccttaatgcttttgaaaagtaccagtctgatattttgtataatgtccttaattttgagtttatctgatgttttctcatgaacagactgaggttattaatttgggggaatgaataccacagaggtcatgtacccttctgatatagtttggatgtgagtccctgcccaaatcttgtattagaatataatccccagtgttggaggtggggcctggtggaagtgaccggatcataggggcagatttctcatgagtgatttagcaccagcccccttggtattgtcctaggaggacatgagtgacttatcctgagatctggtcatttaaaaatgtgtaacacctctccttctctctcttgctcctgctctggccatgtgatatgcctgctccccctttgccttccactatgattgcgttccttgaggcctccccagaagctgagcagatgccagaatcatgcttcctgtacaacttgcagaactatgagccaattaaatctcttctctttataaattatccagtctcatgtatttccttatagcaatgtgagaatggcctaatacatcatctcatcacatcttatcagtggcacgtgatattaaaatgtcttattactggtgatattaactttgattatgtagttaatgaatgtctccaaattcccttctgtaaagttattatttccccctttctctaccctgttattaatatttataagaaggttactaagtctagttcacagttaaagggaggggaagggagatgggaggtgtagtgagacacaagacctcttataaagacaagatgcatgtttcagaaatcattagctcaccaagaggccatgacaggatggacttctattcaggagtaaaagaaaataagtcatagagttgataaacacatgatttggtgagggcttccatttaggcaaagttgttgcccttcaatgattgtgacttttttctcctttcttctaagattttttgtgattgttttaaccttctggtgaattatcatggtgatagcagcatttttgccttgtgcaatgctttaaatggtataatgtacacacacacacacacacacacacacattcgtatatataatccctcctatctttttttcctagtttttccttttgctttgaaaaccatacacttctccagcatactgttactactacttaaaaagtatcttagccatttctttttttaacttttaacttttaaattcaggggtacaagctcaggatttttacttaggtaaacatgtcatgggggtttgttgtacagattatttcatcacccaggtattaaccctagtacccattagttgtttgtttcccaatcctctccctcctcccatcctccaccctctgaaaggtcccagtgtgtgttgttcccctctgtgtgtccatgtgttctcatcatttagctcgcacttataaatgacaacatgcagtatttggttttctgttcctgcgttagtttgctaaggataatggccattatcttagccatttgaaaataatgatttaacctctctcaccttcattgtcattttagaagaaactaccatttggtgtcctgctgagacaaggtatgtagttcgcttttatttttctttctttatgtacatgtagaaacaaacatacagttctaagttttgaaaattaaaggtttagggacatatttgtgttactttaacattaattttatattacatatctttgcaaaatgctgaaatttgcacttattttagccaggtagaaaaaaataggaatggatttttaaaaactgtttttggtgctttactgaaagttgttttccccctttcacctttatttgatatgaattttgtcccttaaccaaaaggaagcacatttttcaaattttcttctcttcccatactttggctccttgcaaccaagaacagcataattttctatatttttttattttacaaagaattatcttttcctttagggtaaagcaactgctttcattcattaaaaagaaaagcaaaaataaataaaacacatttttaaaaagcaaacaaaaaagtacacagcttattcttgtaaaaactttatcgacatggctattttctcttctagcgtttcaggttttagattaaaagcctcagattagacaaatttttgttcctcccaagatgccaacatatttgtatttatatattttaaaaattcttgtaagttttattattttctgccaaaatgattttagcatttaaaaatccttatcattaaaaaggtaaagaatatagaccattaattctattatttttatgtacttctcagtaaatctctgcaatttaccaatacagtttctcccccatattatggaaatgtctcttattacgaatgtggttattgtctttcttttcattttcctaatctttccaagactctttcctcaggagaacctattatttctattttaggtctctattctttgttcattctaaaattttctttcttgccatttttatctcattgttctcctactttttattctcagatgttttctcaaaatatcctcctcgctactgattcaacatccctacaatctcaattatactcttctctgtgctcgatgtgaatattgctgggattttaaaaatgttcactaatccttaattcagtttatctctaaaaatgtgtgtgtgggtgagtgtagggaaatgtagggaaaagaaataattaaggaacacacactgtctccttaattatttcttttctctacatttaagggtcatatctttctacatatttgagtataatagtttcttaaaattttcttttgaatactgcaattactgacagtagcttactttttttgagatttctgaaacttatctttcctatctattgagccttgtaagttctctttacacgtatgtttatgtctatatctacttgtctatctgtgtatctatctttgtagagagaaagacttggacaagttacttgcaaggaagttattggacagttttttttgtgaaatattgtctattttcatctttgaaaatgtgataactgatattatatatatgaactttaaaaaattaatataggcattaaaatggtttcacattcattattggaatttctttaataaattgcctgttgatgtattttcctattttttctcttgaggcattcataattttatagttaattttcaaaccttctttgcttaccaagaatattaatactttttctggaaaatgcctagcaaagactttttgtccatttaaaaatgttccactgtttcctgttatttatgacttaatgacatttcagaactttaatacactaatatccataaatctcttcctttttccttagaaaatattttcacaactcaagacaagttaaatatccacttatgggaacagtgctgaaggcctggactaggatggtagcaatggagacagactaaaggtcagcataacagtcaacattaagggggttgaatcaacagcacatagtacctgattggaaatacagagtaaattacagtgagaagtgagttgctgtccagatttctatcttggatatgtagacagatgatggtcagcaagcaagaaaacaggcagaacaattttagaaactaagaaaatgtatttccaatggaactaattaaatcagagtctgtaaatagcattgtaagatataggaggctgatatggtttggatttgtgtccctgcctaaatctcatgtcaaattatatctccaatgttggagaagaggcctagtggggggtaattggatcatggagctggattttccctttgctgttctcatgacagtgggttctcatgagatctggttgtttaaaagtgtgtagcacctcccccttctgtcttttcctcctgctctgaccatgcaagatgtgactgcttctcctttcaccatgattgaaagtttcctgaggcgcccccagccatgctttctgtacagcccatggaactgtcagccaattaaacctctttttaaaataaattaccctgtttcagatatttatcagtgcatgaacggactaatacagaggcagaagcacatctgcaggcagaaatggggaaaaaaataatatcagaagaaaggataagaggaagagcttaagaataagtatgtgcaaattttagttgatgctggactggggagaggtgctaatggattcagatcctgggggaatctggacaaggatatggtccagagatcaatgggaggagaagaaaattaataaacttgacttaaggactagcctctaagttgagaaatgtaatgtttatgctaatatttttacagaaaaaggtgttatcattctcagttttgcaacctgattcagagaagctaagccatagaccccaagccacatggactacatggtggcatctatttaaattcatatttatttgttcttagcacttttgttgtggtcgctatgctacctctaagtaggactttgacttcctacaaaattcactgttacacatccaggtagatgtgaatacatgctgcagtaatgtctgtcacccatagtcactgcaggggaagttggcatcacagcactgacgatatgcctactatctttaggttaaagtggatacgttatcattaccctatgcaaaagaatctgatcattgccctgaagataattttgttatctcacattgcatatgtgatcattaccctgagggcagagatgcaatcattggcctataggaatacttatcattatggcttggcaagtggaaaagtgataattaacttgcacgaatagatgggatcattgcactacagatagatctgttattgcatttcctgaagaaatgcaatctctagtgtgcaaaagacaatgtgttatctacatttatggtagagatatgctccttatattgcccataatgatgatatcaattgcatttcaggtggaaattaggattgttgcattgctgataaccttgttataattacgttacagaaagagatgcaatcattcccttgcatatggtccgtatgaagacgggatcattacaggaaaggtgaaggagatacagtcattatgctctatatacacccatttttatggctagcggctgaagatgggatgctttctttgctggaagacctattacctgttaggttgcaaaagatgtgatcatcttcctaaacaataatttagagtcccataacaattttaagtgtgctgttcatgaaaatttgaatacattgtattgggaatataatggaagtgagatgcctcatgtcgtgagaaaatctgacataaactccttaagcatgagaggccatgtgggtatggaagccctgaaagggaggaaaaaacagccagaccctagctgttccagtcatcccaactgaggtgccagacttgtgattgaggccatcttgcatcatctaggcctagtagagctgccaactgactgcagacacatgagtcaatccagctaatgccacatggagcagagacaagccgcccagctgagcccagtccagatgacagaatcatgagcaaataaggttgttgttcttttaagccactaaattttcgggtgatttgttacacagtaataaataactgaaacaactatgtacagtttaatgatctgaaatcaatccatagtgttatgatagcctttttaacaaaattgaaatgataacttattcatttacaatgcaaatcaatttaatggcaatagttacaactgccctgaaatgatctaaagcctcatgaagttgatttaatatctagctacccaacatacttaatcacatgttcacagttgatgaatagtgactgaatctccatgagcaagataatagtaaagctctttttttctctttctctttttttccagatgaataattttacatttacactgataaaaagttaaagttgcagctctgttttcacactacctgagggatctttgtagattacataaaccctaagcctcctgtgtaagttaaggaaaaaaattccaaactcacagtgttatcgagaggattaaataacataatttatgcaaagtcttaaccatagttgctagcatttaaactttaacttttgtccatgtctctaatgtaatttaaaatgatcttactctttaaggtttgatctaatagaatatttgtcagacacaaagaccaagatttgtcccagttgatgaaccctgggtataactcaatagcatattggcagtttttattttctgttaagtctggatccattcaattagtgatttatttcttaatttgtcaaacattacattaacaaagtaacaacttttctatccatattatattgtggttacaaaaaatggatcaattatatttgaattaaaaaatttaattgccaccaaagaagagaaaaataactagagaaaaataaaagagatgtgtcaagaaggaataaagaggctgataacatgagatctcttctagctttgaaacatgtcttgtgaaatgactaaaattttaaaagctaggatcaagtattggtgaggagatgaagtaattctaagtctcatccattgctaatggggtatacattggtttaaccagtttggaggactgtttggtaatgtccaaatatttattaaagttaaacctactcctaagtcttatagcccagaaatttcaaacctaggtaaatacctaagagaaataagagtacatgtcttccaaaagatctatacaagaatgtgtatagcagccatagtcataactccctaaaactggaaatgacccaaatgtccataaaaagggaaatggatacatgtatcattacatatttatctaatgaattgctatgtcgctgtaagaatgagcaacccactgatacatgccacagtatcatgaatcacatagacagtatgctgcctgaaataagccaaaataaaaaatgtcttatttcacttatatgaagttctagaatatgtaaacgtgatttatgatgacagaaattaaaatagcagttccctttgcatagggggagcgtattcattacggaagtgtatgataaaacattgtacattggtggaatgttctatatcttcacttgagtgtttaccaggatatatgtccacaaaaaagttaggaatccatacttaagatttgtgccctttataatatgtgtgttatacagccactgaaaataaattgatagataaaaagtaatgtcttctaggttccatatggagaggactgatgaagccagcattaggcgtgatggggacgtgcataaatgtgtatgttatccactgagacacagattctgaagcaccagaacattaaaggcacttctacttgtttcttctacccagctgaaaggacagaaagcttcttccacagagccaggacagtccaggggaacgtagtccttcgactgaaagctatgcttcctattttctaacaaagaggctaggtcatgttgaccacccagttttggcctgcctggcttgctttttattccagcctggaggactttcagggttgaatatccactcaagccaaatcccaagaagcataacctgctattagactcttgtcacttatcgggtgaggggctgtgcggctgttccagtgcttccccacttgggtcttgtgacataccctggggccaagccaagccctggaggttagcttctacagtctgtccttaaagagagctcagggatgtctggacaggacctggagacagtgccctgggccagagacctctgatctctaggccagcagagtcaccatgcagacagatttatgagccttaggcaaaacagctggcattcctgtggccatctttctaccccttcctttccacatgaccatatccttggccagatcttcatgtccttagatggctgttgcctttgggtaaattggcaattaagataaatgagcatatttatcatggccttgtggttacccctcctgaagctctcagggtggcaagctgcctgaccctcctactatgaacttagtaactttaaaacagagagtatcttttcttgcccagctgaaatttcctccccaggcgacctacttttaggattaatatgcgggaaagtctgcagttttgttttcagtgagggtagttgtgttttcaaggaaagaggtagcgccttacagtcagattagccagctttatttctttcatcaaccctttactggctttctaaattttttcaagtaacttcacctctctgagtttcatttacctcattaccttcatcaggtaagatgacatatgaaaagcccttctcaagcaactgcaaagttccaattaatagaagaaattgtaatgactatctgtgtttgaagcggggccatttttcttatttggaattttcacgtattaaaaatatggatcctttacacctgtatgcctttactctccaaattgattcattctctagttcctctatctcattactaagttcaaataatcatcttcctacaaatcactcagtttagatgccttgaaggcttctttgaatacttgctcctgttcacacccgacagtcagtcatcaagccctgtggaacttgtccctggtcaacatccgttcttctccattcctactgccgttcaccacacgcaggccctcattgtcccctcctgggatctatatcctctcctcagcacctttttcttctctattgataccatagacaacttctcatctcatattctctaaactcaactttcaggatatcatactcttattccatagatcagaactttcaatgactttctccttctttacagctcttcataacaactctgaagatagattcagtccttctttttggaattgcctcttatttctttttctttttatgcccatcataaacctcccattggcaaaattaccatgaacattttcttgtgaattcattgccttggttcattggttcatggacgggcaccaccatgagccaattagaatctttccctgagaatctagaatcatggttaagaaggtatagatctgcctgatgctttgttgaatgaagaaaatataatgtcccaagggtggcagccatttttctgccctatgaacttcaaaatgcagaaaatctatctggaatgtgaaagaagaaggatatcaatgtaaaaacaagaacaatatagataagtagagagagaagagagagtgactccccattctgcttttttctgaggccttaatttttttttatttgtcattggtctgctaagataagttatcccccccgcttttttttttttaggagacgactcactctgttgccaggctggaatgcaatgccacaatctcggctcaccacaatctccacttccagggtttaagcgattcccttgcttcagcctcctgagtagctgggactgcaggcatgcaccaccatgtccagctaattttttgtatttttagtagagatggagtttcaccatgttggccaggatggtctccatctcttgacctcgtgatcttcctgcctcagcctcccaaagtgctgggattacaggtgtgagccaccatgcctgggcaccctttttaatttaacaacctggagttagatttctatatttgtgacactgggagtcctacttgttttaggacctacataccaactgtcatttactgaaatgatatttagccatacattttttcccatctgattataaaacaaaaatcacaaatctagagaagtttgctccaatattctaaaatgcttggaacatacataataatataattgaaactcccttccctcttggcttttctgaccttgaactctcctcttttctgactcctcagcccagcaccaccccttcctttcccttctttgcctctcctttttctactcatcttccaaaagtaagtaatgttctgcaaactgaccttggacttattctcttgtctatttgcaagttctcccttagtgtctcatcatttcctggcttcaactattattttcaggtaaccatctcctcatctttacatcctaacttcttttactgccccattctaacactaccaactcttcgctagacatacccacttggattctcctcctgcttctcaatctgaaaatgcctaaatcagtggttttcaactgggggtgattttgttccccagggacatttgacaattctggagacattttcttattatcacaactggggttggagatcctcctagcatccagtgagtagaggccagtgatgttgctaaccatcgtaaaagaacagaagagcctcttacaacaaagaattatctggccaacagttctgaagctgagaagctctgctctgaaacaaatctcaccatgccctccctgtatttcctctatggcctaaatctgatcattttcctgtgtcctcttgcctgttagtgacaccttcaacctctaaatcacccagaccataaatttcagtaggtcttgttcaactatttgtcaaggatgatttataaagtatgcttacagtgggaaaaaaataaagtaaatattacttctaaaatactttctatatctaggagtgtttgattgtatcaatcttaaatataaatattataaaattagacaagaatacatttaaacatataagaaaataaaacatttaatttcaaataccttatctatcaaatagattctggttaaagcaactaatcttctactctttagaaaaacaaacttattgggaccactcatatattgctgcaattttcctgcacattaaattaaggggagcatggtacaacttctgatgaggatggcaagcctgtctagtactctaacattggaatatgggctttataagcttcttatatgtgttttgaaagggcaacccaaagaaaatgcaaagaaaaaggggatggtcaacagataaagtttttatcaatttctctggggaagaaagtagcttcctatgaagctaattccctgcatagcatttattcctgtctgatgtttgtttattgttaatttacctgtttgttttttgttgctttccactagaatgcaagacccacgaattcaggggacttatatactttgttagctgttacatctccagatttaaacctatgctttttattaggcattctatttgttgaccaaaggaatggattaatgaatacatgcttgaataagtatgtgacttatatgaggtccagtgagtgtccacatgacaagagcttctgctcagggtccagatctatctaaagatagtggaaagggcatgggacttgactcaataattcatctaaagctgttacttttacagttagatgtttcagaattcaaatttcaggttttccctgttaggtatgtgactttgagagaattatttatcattcattcatttatttaggcagtagtcattgcttgagttcctaatttatgccaggtcctaggctagactctggaaattagtggcagagatggccaacagaaacctgtcctcaaggaactccctactaattggagagacagccattaaatgtattcataagggaatgcattgctttgaaggggagaaatcacaggatagtatgggattacatataggggatatgggaggagctacgtatgtctggtgggttttctgtatctatgcttattaatctataaaataaaggtcatacaaacttcctcagtggtgtttttgtaaagataaactatgaaatgatctggagcccatattggttgcaggaaagcgacttagtaaatattggatccattctttcttattcccgctgagcacaggagcagctttgggaactgcaacctggggctggtgcgacccaagcacatagcaatgaaactcatctaggccttttcttccttctagaatagtgacaacagatgtgagaagcctaatcagctgattgctccataaaatcataagggctgcaggtctgctccacatggttgaatcgaaggcttctcaattctgccactttcattttttggtccctcttcctgaaattacttaagttttctactcttacctgaaatgctcacagttgggtgtgatgagtccttgtatatgcaatctatctggctttctagaggtcatagaggtcatagcaggctctagattattcctttagtcacatcttcttgacctggcaagctaaggattagctcgtgagccctctttaagaggaggggctcatctgggttcaccgagattgcaggaggcaaagtgctgtagggcaccacctcattctagtgctacgcattgtaactggctgacctctcagagaccacactgcggccgtggaaatctgccttttgtaagatgccctgagaaactggagaatattagagaggaatgaatataaaagcagtaaacacaacaagcctttgttgaacttagtaattgccatcactgggttagatgagcaaggagaaggtttatgaagctgtgtaggcatggttttaatcatatgaggccagatcgattaggcctggcatctcagtctgaacagatgaaagggggtgtgataaaacccacatttgtaggaggtacctcattgggatggtcaaatctttcttacgtgccctatgaacatgggcaagttacttaccccctctacatctcagcttccttacttgtgaaataaagatggtaatagctatcacgtagggaacagagatcacgtgccaacactgtgcctagaacctcacctgcatcagcatgtatcacactcctaatcatcctgtgaggtaggcagattaggtgtctatgttttacagataagcaaattgagtgtctaaatggctaaataactcttccaaagttacacaaacggtaaactgaagagttaggataggagtctggctaatataatgccaaatccattctataaattactgaatcataatgatcttatagagtccatgtgatgatttaatgagatgttaaatgtaaatagctgctcagaagtaatttttagctgctattgttgtggttattttcattagcatcaccatcacaatcagataattgtggaaagtttcttacttagattcagaagtacagattatacaacagcattaagtgtagaataaaggaaaggagatcctattcatcagcaaggatgtagcgaaggaaagtttaaaatattgactgtacaaggtccaacttctctgatgggcttgggcccacaattcacctaagctgagattttttcatgataggaagctgctgctaattatttgcatacagtgcagcacaagaacctgcccctgaagtcatgtcactctagtatttagcagcttctttatgggaaagatattttatattaataccttgggaaaagtagttacagcacatctctcagagataaaataccaaagcaacactcacttccatcttgcataagttattgcaacaatgatgctgtgtaacaaacaaacacaaaacacaatggcataccacaataagtgtttattgttcatgtgtctgaagtgatcagctaaataaatctggcattcttggatttatgcgtctgaggattggttgtctgcctatctaggctagcctcctttgagatatctggaatggcttgggtctgtgtctcatccttctcctggaactagcaggctagtctaggcagatccttgctgatgacaaaggctcaagaaagcaagcaggcatgtgtaagaccacttgaggaagtagaaatccaacagttctacttccttcacttagctaaaggaagttacatgggcaaacccaaaagcaagagatagagttgacctgttgactttaaggaactttggtgaaaggaactgcaaagtcatacagaaaaaaagagtggttataggaataagtgaaaaatcaaataatgtcattatctgcccatatcttttcttaaaaacggaatccatatgtgtttgaattttattaaaggagccccacccatatcattagtctagttttatctccaagataaatatataacacattcagcaaatgggttgaagtcagggtcaggtttgttcctgtttattgtctcacccaagatgagcaccaaggagttcagttgttctcacatgtctgtgtgttgctgggccttgtttctttaacaattaattcgttatgagaacagagcttaatccaccctctttactctcacaatgtgtgtgtgggtgtggatgtgggtgggtgtgcgtgtgttaactagcctgtgaaagactgactttttcctagagtcatcagccttgagggtgactctgagaggtcctcggtttatactggaggtagtagagtgaagtggttgattatacaggctcggaaatgaaaccagccaggattcaaatctcaactcttatgtcttaaatatgagatatgtacttagttactgtaatttcatggattttaagcttctttataaaaagagtaaaacttctaattcagagagatgttgtaggactaaacaagatattatgttttgaaagccttttgcagtgtttgcaaaacatatagtaaactgtcttgttcggtcttgttaataccgaatattttaaagcatatgattttaataataaatgagtgttattggttatggtctcattatcatcatccattcatccaaccatccatttcctcgtagatgatctacaggagtcctaatcatttctaagtcacattacacaagatttccttggtcaggaaaaggttttcacttaggacagaccattatctcctttattctctttcctctgaaattgccatgagaagaaaatgccacgaagaaccatgaaaggcttccctcttgtctctgtttctgcaagcactgagaatacatgcttctgagcatcctcataaaacactttataaaaacattcatagatttacagatagaaaataattcaccctggcctcctgaaaactaggtgtcaattactctacactttctccattggatccaaacctcagaaaaattgttgttttaccattttatttgctaaaagtagtgactaaacgaaaaagaaacataggagaatatatttgtgcatttgggttatgcaatagtttcttagatataacaccaaaaagtatgattcataaaattaaaaacataaaaaattggacttcatcaaaatgaaaacattttgctcttctaagaacactattaaaatgaaaatgcaagtcaaagactgggacaaaatatgtgtatatcatgtatctgttaaaggacttgtatccagaacacataaggaactcttacaattcaaaaagaagaaaacaacccaaatttaaaataaccaaaacatttaaatggacattttgccaaacaaaggtacacatggttaataaccacatgaaaacctgcacaacattattagcaattaggaaaataccactccatactcattagaaaagttataatccaaaagactgacaataacaaacatcggtgaagacatagagaagctagaactctcatatatttctagtggaaatgtaaaatgatatagtcatgttggaggaaagagagagaaccctaaatcctaaccaatagacaccatgtaagatatgatacagccattttggaaaacagtttgataattgcttaagaagctaaaattattcttaccttacaaaccagtaattccacttctaggtatacaccccagaaatatgaaaacatgttcacatatagacttgtaagcaacattcaaagcaacatcattcataatagccaaaatgtgagaaaaaatgcaaatgctcatcaaccagtcaacagataaagtgtgatccatacaatggaatactactcagcaataaaaaggacagattattgatacataccacattttgagttagccttatttcactgtgctatgtgaaagaaaccagacataaaaattgcatagtgtaaggttgcatttataagaaattcctagaaaagagaaatctatatgtagaaaaaaacagattagcgattgttggagactggggattagaatggggattgatgacaaataggcacatgtagagtttttaaatgatagaaatgtcctaaaaattggagtgagggatggttgtacaaacgtatacattaatttaaaaacactgaacacaaaattggtggtttttatggtatgtaaattataccttaatgaagcagttttttttttttaaagttaaatgagatctagaactctagtcaggactgtgttaaaactgctaacgttggagttgttttcttcccaaaacaattcaaataatgctgctcgttcctattaggcaatacatatttcatttctagtcagcatgtggtgaggtgatcaccttattattttctttccttctgcatactccagatgcacttttgacttaatatcttcgttgtatcctcttaattaggttcttgctgtttccttgagaccataccttcagtagttcatgcctagtttaaattttatcctccactcagatttaattcaaaccaccacattttaaatgccttatagtttatttctgtgaatgtaagaaacacatccttggcttgcttttacaaattcattactgaagagatggactagaggggccaacgattgattccaagagacaccaattgctctattcccctgcctgataatgagcccatacccagagggaatcggccagtgttaaatctcataatgacaaacagaaatgtgcagcgtcgttatcactaagccaacaccattaaaggccagtgtttattgacacttcaggtgactggatgatgcctctccaggccgagctaatgaggagaacctctccattacctcttatcgagatttagcagactccatagctacccaatgaaagtggaaattactgggcaagcactgacatttaccagagactggccttcagtcataatgcataaggcactcaaggacagatttgtagactcagaaatccagtttatagaggcttttgttttagcctgttgtttgcaaagcctgcaccctcaaacatttttgctgctctccacagtctagtgcaaaagtggttgttttcatggatgtatttcctgccacttgtcttaagcacgaaaaaaagaccaaagcacaaatttgaaagtctttttggttcttgtattctttagaagcccaccatagttgttgttttctgatgggatttattcactcaatcccaatcattcatagaccatctccataaatttgcactttccatctactaccaaattacttgcactttcaagtaattaattaattattttcttaaaccaattcatattttttaaaaaatatttttcagaaaggaaatgtaatcttactaccattaataaaagataagattaaaaatatatttaaataaacacgtaactattaattgctgtttccctaaccaatatactttctaacctaatatattaacagaaccatgttttgctttgtttcgttttgctttgcttgtttccagagtagcaatgtgaacagatataaactacattttccaacctcctttgcagttaggatggccatggatatggtcctgggtgacaagaataaaaagatgatgctcaaaagagattctgggaaaaccataagaggagggtgaggcaactgacatatacctttgcctgtcctcttttttcctgccctgaaaatggtcacagtgttaaagatgaagtggcaattttgggtcaatgaggcaacaagcatgaggttgaaagtcacactcaggtcagaggaatttcaagatatctactgtacaacatggcacctatagttaataacatgctttattcttgatgattgtcaagagagtagattttgagtgctctcaccacataaaaagataagtatgtgaagtaatttatgtttatttgctcaatttgggcattccaaaatgtataaaaatatttcaagagaccatgttttacatgataaatatgtatatatttttttatttgtcaatagaattgttttaaaagatggccaaacagaaatatagtcagaatagggtcttcgattattgtgcaagaaaaaaatgaactctccacttgtttaagcaacttctaaatcaggttttctgttactagaggccagtgtagttctcactgagacatttatctctgtcctacttaaaatcacttcatgtgccaccatcagcatgggcatcacactttgatcaacattctgctcattgaatatggtatgtgtagattgtctttcctgaagatagagatcattttttattttttactcactcccatcaggccagaggtaaatttaggaaggcccaaagtggtctctttcccatctaaatatatatatatattgtgggtgggcagcctctgtattcttcctctaattgaaagagatttaaatgcttatggtgtgaattcaaatttattcaaatatgaatgctcacaatattgacaggccagtccatagccagcccaacatggaaagaggactacaggtgtccatgcagtttgttctaagttatggctgcagctactgcctgtctctgagttttaaggatgatgtctctggtgactccattcttgcttacttatagaataaagcattcagaacaaataagccagtgaccagcgatttatatggccaaaggttctgagcttgctaaatttatattattttactatcctaaacatcaaacatttaagcgtgtatagttcttgctcacagatgagtaatagaaattctttgaaagatactatagattattataatagtaacaataacagctgccactgattaaacttgttctatatgctaagagtatgctctcacatttgatctttaagcaatcccatgggtaactattattgggtatttttttgttattattatctctattttacatttgaggacattgaatcttagagaagtcgaacctcttgcccaagatcacacagtgagtaccatgaacaagaaataaaattcttccctgtgtgaacctaaagccagggcttttaactatggctaactttgatgggtcttaatataaaaatatcttgacatgtttttatgtttgttcatttctattaattatttataattaagttattaaatattgatgtatattcatattttatattaattcaataaaactcttaataaacctctaataacataagccaattaactaagtgaccctgggcaagttatttatttatttatatttaattaacacatatggcctttgtgctagacactgtcctaaggagtctgtaagttttacacatttaattcatatttcaactcaatgagctaagtactccatttatacaagaggaaaccaaggcgtagagagttgaagtaacttggcaaaagtcatacagttataatagacttacatagtcatactagtcatacagctagtcaaacggccagtaatggcaatgcccttatctgcaaaatgagaaggttgtagtgggtaaccccagaactcttgtcacctctggcattctgtaaactgtaaattttgaatttctggcttgattaatgattgattaattgatttttggttgagcatataagaaatatgctgccacagaggaaaactggctttcgtagccctttctgaccacggtgtttctttcagctcagcaaaaggcaacatctgtgtatatgcagagtacatatctataccctcaatgtatttctgacaagttcagcttgtgatccctgtgggcatagctggtaagtaagtttaaaccatcatttcccaaagacagaactgtgatgaaatgattacttcccagacactggagaataccactcctgatgcagtttgggatgtctttgtgatagcctggcaagaatctccagaatcaatcataagagacaagacacagtaacagaagtcagacggcctgacatagtgtttgttgaccataacctgaactggagcctagccattgatcagctttgagaattcggctgtcagtggtttaagcacacatccttaggaagatcagaagcttccctatgtgtgaaaagtaacctttgctggcagagcaatgccataacttactttcctaggaccctcccaatgtgcatagagatgagtggtgggatgctctcttatggagcaagcaattttgttagttactattgatgtgctcagatatttgtagctctagctactaatgagtttcagtaggaatgccagcatgaactcactcagcccagtttatttcagcaatacattactgtgacaggtgatggtgatcctccacctagtttctctttaccagactggtgcccttaacttcgttcttctgggggtgttagctgctcatggctcacacttttatcctcttctggaggattttccacagctgatagggcctgccttgtgcatatacctggaaacttttattccttttcctggaggtggcccattgccagtagggccgatgtaggtgtgcaagagtgtaaccccctttccctgggagtggaaaagtgatgggggagctctctgagtagaattcattctctggttctctctgtggcatcggagtaaggtgaatctccttctggactctttcttttctatcctgttcccctgtagccttacaggtttctcttgaaagcaacccctcaatatgtcacttacacaagaatccagatctatcaagcaagaggaataagttcaagttcataagattcttgtctttaactgctgagccccacccccatccttggcttgtgtccatccaaaatgtcagtactctttgattgcctcctggctcagttaccttcatgttttactttcccctcatatccctttcaaacaatagaagcttctttcactgaacataactgcagctccttcaggagatgggggaagaaggcagtgtcagaagagagactattctgcactccttggagaaccagtgaccagtgggtatgatatttaattttaccaggagcatgcatcagaaaatagtccacaatatttcacacaaagagtcatatccagaacaaggaaattaaataggttttaattgaaaccttaatgctacatttgagaaggaaggtcagattgaaagaaaattgatttctgtaattgataattctttttcccacatatccctgagcacaataatcataactcttaaggaactcagaaatgcatggtatacaagggagtgacatgagtacacttatttcaaaatggagagagagacttcctgcctcaaactatcccagatatttaaagatttgaaacatttaactaaatttttggtaactcaaatgttttgccactcgttagacataaaatttgttttctatcatctgtcagtttcactctacattttatttcatggatgagacagaatgatcattagtagttagttggttgtaaggggaaacataaaataaaaatagaagttcatgggaaggattttccatatgcatctgcatggaaaaaaatttaagcaaaaggatttaacgtgctgatatttcaaactaccttttcataggatgaaatatgatttgcctgtatgtgattctgaaattcagatagtagaaactctacgggcaacgctatctcctctagaagttggtaaaataagaggcaagtcttattaaaaataattataattcttttcaaccaatatttatcggtgactcactcagggtcaaaaaagtaaatattttttaacggtaagaaggtacaaagaacagtatgatgccaaggaacacatgccactttttgatggagaatatgaaagcatcctgggggaagaaagagatgatgcagaccattcagagcaggtaggatttggataggtataaatcgatgttgaaaggaaggggctagcaacaagaaatagaaaggctataggctcattggaaggaaaaggtaggcattgttcaatgaaatgccaaaaaatatttggcacttcggatactatagaggatgcggaaaagtaatctggaatggtaggttggagctatggaaagagaatcaaggtgtttattgtttcagtgaatgtcaaaacatatgagtgtgtatatattggaatagaatgaagagatctcaaaggtggaccatcagttagagtgattgatatggcagtgatctaaaacaacagtccccagactttttgaaccttggaccagtttcatggaagacaatttttccacagtgtggggggatggttttgggataaaactgttccacttcagttagattctcataaggagcgtgcaacctagatccgttgcatgtgctgttacaatagggcttgtgctcctatgagaatctaatgccaccattgatctgacaggaggaggagctcaggtggtactgctcgctggcagctcacctcctgctgtgcagcctggttgctaacaggctgtggaccagtaccagtccacagcctgggggatggggactcctggtctaaaataagtaaaggaggcatgaacacacaggtgacagtggaagtcaaagggaacaagaattttaatagagaagaaaagatcaatgctggcacaaactatagaaggaatgaggaagaggaaggtcaaaccaaagtaaatcgatctggcaaagaggaagtcatttggtcaaccaaagccggtatttaatctatactgtcatactgcggattcctcccaaagccaacctcagcaacagaggttgagtagtggtagtttgtttgagaggtagccctaggaagaacaaggaagggggtcagaacagtgaggcaggaatagcagaagcgaatagaggatacatgaatgaggcagtgagcaaacggagatcctccagagggatccatagaatgtatctagaattgttccactgagggaggggtagagcccagggatttgtgcagtgatttcggctcctaattgcttggcagttgcccgcaggggcatcaaatcccctcttcaatggactggtctgctctgagtagggcaagcccctgtggccctgctcaggtagaaaagcagaaacattcaagccattgaattatgcaaggagtgatccactgcagcctcagataaacttagaggtaagcaagggtataaataacaacttcttcaagtacctacaagttctaggtgtttgcaagtggcttctatttttgaggtcacctcacagtttaagatggctgctggcattccagctatcacagctactttgtggacagcaggaaacactcatagaagagtccacttcgtttaatcagccttcctgtaagtatcacagaacattcattcaccagaaacagacatatgaccaatcttgctggaagggaggctgggagatgcaatattttagctcgacatattattgttccacatacaattgtgcttggttttaaggaaggaaaggtacatagaggttgtgtgatagccagcaatctctgccataccatataaaaacatatttaagtcagagttttaatttcttttttatttattgattctgtgtcccacccactagatttctagttccttgaagacaggaactgggttagctttactgtgttattactcactgtgactcatacattgaggtttatttttttcccccagaacagtctagcccactttatcccttttggctttttaagtaaggacatcagtatcattacacaaattaaagggaagagaggatgaggatgcccaatagccagccataatgagaagtcaggaattccaaaacttgaattttagattttatcaaagaagcaggtggagatgaaaattatgggttatctgatatatttaattattcaaaatcgtaaacaaacgtactacacagaactctttataacaaattcttcatttttcagcatacactcacccaaacataaacctacaccactattctctagccggagccatagctgaaggtatttttaatgcctttcatgttagtgaaaatatctctgtagtagctatggacttgaactcagcagaccaagatatgagtctctattttctattaccagcaagcaagcactgacaagctgtttatcatctcctatcctttgtttcctcacttttaaaacaagcatagtcacactgcaggggcttttgaaaggaatatttgaaaagctcctgcacaagtcttagcaaagtaggctatcagaacacgaactttaatctgaatctcttctgttgtgtccaagactaaagaggagtctgacttgatctttggctcctttgacattgggagatcactgctacaaacaatcatactgtgagaagcccctgggattcctggagattcctgcatgtctgtctcccagactcttaagcatctggccttgactttctacaaaatgtaaaggaggcctccaaatgacagaccttagggggaacatctccaaatggttcttccaagcacaatgaatcaatcccctctccttgcatattctgagaattagcagaaagtacatacatatttcagagttacctcttaatacaattacagttcattcagccagcaattacagtaatagaaagattggcgactactgcaaatcaggtttaagagaactgatggcccaaggggctaacgcttcattctgtctggctctagtagcagacttggtgggcttgtgacccccatgtggtgtgtgtgtgtgggtgtgtgggtgtgtgggtgtgtgtgtgtagggagactgggcactcccagtggtgtaggttgactgattatggtgaccattttattatttttatttttatttcaacagtttgggggatacaggtggtttttggttacgcggatgagttcttcagcggtgaagtctgagattttagtgcacttgtcacctgagcagtatagtctttcatccctcaacctcctccaaacttctctgtacccccaaccccctcccgagtccccaaagttcattatattactctgtatgtctttgtgtcttcatagcttagcttccacttgtaagtgagaacacatgatgtttggttttccatttctgagttacttcccttagaataatggcctccagctccatccacattgttgcaaaagacattatttagttcccttttgtggctgaatagtattccatggtgtatatacaccacattttctttaccactcattggttaatgggcacttcggttggttccatatctttgcaattgtgaattgtgctgctagctataaacatgtgtgtgcatgtgtcttttccatataatgacctttttttttcttttgggtagacactgaaagccttcacctcctggtgaagacaggaggttattggccatgttagacactgaaagtcttcatctcctgtggctcctatctataccagcctcatagtctggattctgtggttttaagaaactactctgaagaaataaatgtggacagagcactacaggaaaatggtgactatagtaaaggcagggggcacgggtagtcctctagtgcttagctatgccccattccaatgttgatctccaaataacttctcactgaacttcatgtaagcctttgaagccaattacttccaactatgtctcattctctcaaattaaaatctacatctgattcattctctctgaaatacatatgcccagatatctaaattcaaatggcatctagctggaaggttggaatacccgtttacttcctacaaatatattcacaaagaagaaatgattttaaagaacagcaacaatgacttaaaaaacctaaagacaaaaaacaaaaacaaacaaacaagcaaaaaacgcccggcatggtagctcatacctgtaatcccagtgactagggaggctgaggcaggaagacaacttaaagcaaagagtttgagaccagtgtggcaatctactgagaatccctctcctaaaaagaagagaaaaaaataaaaataaattagttgggtacagtggcctgaacctatagtcccacctactcagaaggctgaggcgagaagatctcttgagcccaggaatgagtttgagtttgcagtgagttatgattgcaccactgcattccagtatgggtgacagagtgagcccttgtctcttaaaaagtaggaaataaataattttaaaagacaaaatagtgttagaaaaatggtagattgaacaatatttataaagtagaccagtctgggttagagcaaagacgaagaaaaagaaacatagaaggcagcttgacactgcgttcctgttctgttcactctccagaaatccagcaacctatcaaattaaaaagacctagcagcttatttctctgtaccatagactggtttttatctccactctgctttagactttatctctaccatagatttttaaatctgtattgagagaaagaaaatatcttaacgaatccttgtggaaatagaatttcaagcatacttgaaatgttctccaaaactgtggaagaaaaaaatacatgaaaatgataaaagataaactgatagacattgaataagaatacaggaattttacctatgaacaatttctccttttggaatatggtttgagacaaagaaagaatattacagcatatcagaagaagaaagaaaggtaaacagaaaggaaaggacagagaaagaatagaagcaagagaggaggggaggaggggaggaggggaggagggaaggggagaggaagagagaaagaaatggaagaacagagaaagggaggaagaaagggaaggaaggaaagaaggaaggaacaaaaagaggatggaaggaaggaagggaaggaagggagggagggaaggagggagaaaggaaggaaggaatgaaggggagaaggaaggaaggaagggaaggaggggagaaggaagaaagtcctttcatgcactaaagaaaagttagtacctacaggtggaaatagagttataactgataatttattgatacctaaacagaagaaaaaacatggtttttttccaatcatgagggcacaaaaaatttctatattggcatcatactttactgttgcaaaagtggtctttctgtaactctcttaaacatttatttcctcataatcacagagagcgttttccatgtgaattcgcacaaattccttgcttagaagccctcactggctctccctcatccacccagtaagtcccagattcttgaacaagacttggcctataactctctctcatgtctcctgcaactgccaatctgtcactctctcaagagccctgcaaaaaccatgctactcaataaaccacagacgtcctttctttctatgcccacttaacgttacttttcattcagatcttttatatcccatcttctccagaaagctttctctgtaccctcttctcaaacaagaataaatctttgtatcctgtgctaggatataatgaaaacagatcttctgtattaatttgtattaatagctttttatgttaagttgaatttttccatgtttgttccatcaagttcctcccctaagattgtgggtgttctcagaattgagtatgtgccccaacatctaacatggtatctagtccataatacgtgtgagattgtgcttgttgacctgaatcatggaaaatgcctgggccgtatatgaagtacagaagagctccaggtgtgaggtagtgcttggtaagataaagacttcaatgtagcacctggtattgtgagggtgacctgtctttcctgggtcttcagcaatgtaggaacttctttggcagtagttttaatttaatcctttaatctctaattttgcagcccatttagaaataaaaaaattacaagcaaagcttttggtttccatcttaattgtattactttatcaccaatatagaacagagagatccatagtggattacaataagtggagaggccctgtagctggagtgtgcctgcagaatttctaagaaggccagcatgcctgcagcatagaaagcaatggagaagggaaatggaggatgaagtcagaatggcgacgagggaccagatggtggaggctttcaggtcattaagggctttacttattttgaatgacgtttattttgacaacaattaatgggttttgagcagaggagcaagaagacacgacttacattttatcgggatcatttcagcattcttgaataagttgaaaagagaaatcatttagaaaacatctgcacctatccaggtaagacatgatggtggaccaaggtggtagcaatggaaaggaggggcataattggattagggatgtattttaaatgttgagccgacaggatttgctggtgggttgcatgcaagtcagtacttaaatgagattagccatggaatacaagcatcaaaagtaaagagcagagatgatgaaagtgatggtgaggtctgggccattctaagaattctaataaaaatcaaaggggtaagggttgatgtcagttcacaggctatggaactgtcaagaccaaagaccctgtgaggtagctgaagcaggaaacactttccttttatgtatcaaagtctccaatcctaatgctgtgctggagaacttggacctatggtgcaacctggcagtcaatgaatcaggaaataaggggtcagcctgatagaacatttaggagggagtgtgactcatagatgacaatgtcttaagaaggtctagtatgtttactcttaagcatcaagaaacaaatgacgattttcaatactcggagtatactggcagaggaatcctgaatcaactggcataggtctgccactgatgcaggaagttgaacctggcagctgcagccaatcagagctgaagaacagtcaagtcaaggtcaggacccctcttccagcctttgagcgttggcttctgcttccctccctcagtcctgatattccttactacttccactttcaaataactgaattacagccccagaccatcttgttctcccttgggccacagcaatgcaatccaccttcttcttaatcctcctgcagctccagcctgcagtttcaagacaggtgcacaaagttccttaacagtttcctctcattcagacacaacttcaatgaagtgaagttagggaacaaaatccactctatctactgcctcctatctttggtccactcatctcttattgtctcaagtagggattccctattctcattcttagctctgtagaactctgctgcctggaattcctggccctgtcagatgaaacgcgaggggaaaatttagacagatacaaacttagccatcatagttttgggtaaattttatattcacagttgtctgatttggtactgttcaaagctttttatgacaagatcataatgacaaaacttttaggtctcttggcagggaaatcaagaatgttcttggagcagctagttattttatatatagagagatatctatctatcgatataaataaaacatgtatacatatatatttatatataaaacacatatatacatatatacatgtaaaagtctatgtttacatatattgtttatctagttgtatgatcactctgcccttaaatgagataatttgattatatttgaaatcatgaaacgtgaaacaaatatgaaatccagattgttatagcatgatgtaactaaaagataattaatttccagatgtttttattcctttttatagtaatcttattttgctgcttatacttattgacatttactttatacaagctttgttctaatttcatctatctctctagaaaattatattctcacagcagccctgtgggcttaatgataatatgacatctattttacagatgtggacacttaagattgatcaaaatcaagtagataacaagtgttagggttggaatcaaatctagacctatttatggtcagattccgaactcttgaagagttcactgtatggtattaactgacagtaagcacatttaaagcgttctcttgggctggggcataaatgtagcccaactatgtttgcattcatttccaaactaaatgtagttaaattcaaaatttttcacaaaggagcagttaggagtttgtctaaatttctgataccctgtctctgaatgtggtcctaaaggaaaagaatctgaaaatccccttgtttctagagacaggaagtggttcttgcaggttcttcttttacaagaatattggtctcagtaaccagaactctgattgcaacatgtaataaattcaatatcactggcctttccaagacaagaaaatgaggaataggttattcattttgctgaagaagagaaaattttcaactaatgtttcttcagtaagaaacctactttgacaaagaagtaaaagatatgtcaataaggagccatattgctgctgtagaagattaacattttgcattgaagtgttggttctgataattttagtaaactttcctgttgacccatctctccaaagttgctgacactttggaattgtgtcccggtggcaaaacttgtctgaaagatgaatcatgttttcagagtttctgtcttccctgctgttgacagacagcagcccttgtcatgcattagcagggcaaggaattcttaaggccttctgttgagaccttactgagtgaaatgcttattattgaagtccctggcaagagagctcaatggctaagcaccaggccacagtctactgtactcccactctttgaatccatggtgaaaataatactctttgaaatgtgttaggaagagaaagaaaactgatgttggctaccatgctaattacagagcttaccagtaagatcttttagcttagtcatgcaagctgtgcctacactcatttattcacttagcaaacattatgaggtcaattttaccaattgttaatgtcttatgtatcctggatttattgtggactctttatagacaaacttcttgactaatagatctatgatcatttttctctgacatctaatccatttccaacccctactaatctggcttttgtcatcacaattaaaaacaagctttgtggtgtttcttttcttacctcaacatctcactgctctttggtaaatggaacactgattttgagctggaaacacgggcattttgaataaaaggactacattctccatccttcattgtggttaggtataaccgttttatatctaattgctggccgatgagagataattagtagaagcagtggctttgttttgtttattttttgttgttgttttttggtgggagcagctatataaagtcagaggatactgctggaagtgccactgtgcctttctacacttacctcttcttttggtttttagcaaacatgatcgctggagatgcagcaactatcttggacaacaaggtgacaagaagcttaatttgacaacaatacaaaaagatagtatcctgtgtccctgatgacaccaagagggtgcatgtaagtcttggaagcctacttctaaatatttgtatgtgagagagaaataaactcctatgctaaggctacttttttgtaaggttttctagcagtaagagattacaaccttactggtctgaggtatcaaagaatacagttcaaggcaggtaaagcaacctaatatttaggagagaattcctggaattaggagaattgaagaaaggctgagactacacttaagtataaacccttcctgaacaccttactgacaattaaactatacacgcctatgggagacaccagaggccaggcataagcacaggtaaaaacaaaagaagtttctattcttagaagctagaactacattgggtgagatttgttacatttttgactgagagcatgctgaagtggcagaatgctaaaatcttcctattctgaagttaaaaaaaaaaaaagagagagagagagagatcttggagctggcagagcaagctggaaatttacgtggaaaaccttaaaagcagggaatcacagagagggtgagtcccaaaatctatatgtaaactctgtccaaatccctggctgacagcaaaactacacaggtaaaggggagacccaaaggaaataaaggtaaaaatacaactgctggaaacacaaagaattgaggagaaataacagctgttgctcactgcaggggacagagtttgcagttcaagaacatgccaagtactatctgtgaggttttttttttaatcctcagaagaacataagagcatccaaatcactaagatatatagacttcaatatttatctttcaaccaaaaatgagtagtcatgcaaaaaaatttaaaaaaagatgagtatgaaccatatacagaagaaaggaagtcaatagaatttgactgagtgtgcctgatgtcagatttagtagaaaaagaattttaagaagctattattaaggtttcaacaattaataaaacctatatttaaataaataaggaaaatgtctcgatagttgaaaagttagagtatatcatgagtgaaaaaagaaaaaaacaacaaaatgaaaattattgaactaaaaattaatataactaagatgaaaaataaatcaccactacaaactaaagtgcttcttcacaggaaaataaacaattaaaaaaataaaaaggcagtctgttgtttagaagaaaatatttgcaagccatatatctgataaggggttaatatccaaaatatataagaaactcacataatttaatagcaaaaaaaaaaacctgattaaaaatgggcaaagaatgtgaatagacatctttccaaaaaaggcataaaaatggccaactgatatatgaaaatgtgttcaatattactagtaatcatcagggaaatgcaaatcaaaagcacaatagaacatcacctcagatatgttaggatggctattatcagatcgacaataaataacaagagttggtgagggtgtggagaaaagggaactcttgtatgctatatatgggaacgtaaattggtaaaactattatggaaaatggtatagcagttcctcagaaagctaataataggactaacccatgacccagcaatccatctgctgggtatatactcaaaggaaatgaaatccgaacttcatagagatatataaatctgtgttcccatgtttattgtaccattattcacaatagacaagatatgggattaacctaagtgtccatcaatgaatgaatggataaattgtgatatatctgtgggtgtgtatgtgtgtatgcatacgtacatatgtatctcaatgtatatataatgcatatgtgtgtagatcacaatttctttattcatctgtcaatgactacttaatatataatggcatattattcagccttaagaaaggagatactgctttttatgataacatggatgaacctagagaacattatgctaagtgaaataagccaagaacagaaaggcaaataccacattatcacacttacatgtggaatctaaaacaagtcaaatatatagaaacaggcagtggaacagtgattaccaagatcaaagacagggagaaatggagagaagtaagtcaaagagtacaaacttgaaattatatagaaagaataagtctacagatctaatgtactatagttaataatattggattgtatactgaaagtttgctaagagagtagattttaagtgttcttatcatatgcgcacacacacacaaaaataactatggaaggtgataggttaatttgcttcactgtggtaatgatttacctatgtatatgtatattaaaacatcatgttgtacaccatacataaagaaaaaaattaccaggtttgctgaacaacagattgaaaatgacagaagatagaattgttcgatttggagttagagtaattgaaattatacaaactgaagaacaaagagtataaaaccaaagaaaatgaataaggctccagagatctgtggaaaaatgacaaggagtccaacatacatgtgattggagaacacaatgtggagaaaagacagaagaaaatacatatttgagtaaatagcaactaaatttcccaaatttggtgaaaaccataagcttacagattcataaatctcaatgaccctcaaataacataaatgcaaataaaactacatttaaacacatgatggtcaaactggtaaaaagcaaacataatttaaaaatatgaaaagcagtgaaagaaacaatggaacaatcaatagtttagttctcattggaaatagcggaagtgaaataatattggaataaaatagtcaaaatgccagtttaaagaaaccctctcaggaatcctatatcctgtgaaaatatcattaacattatagacaaaatagagaaaatttcagaaaaaaggtttttctgcaattatttatcaccagaacaaggaacattttctaatttattttaagaggctagcattacactaataccataaacaagaattaatttattattacaagaaaactaaaaatcaatattacttatgaaaatataagcataaattcttttaaaaataatcaaattgaatttatcaatatatgagacaggtactatatcataagtaaatggacattatccaaacaatgtaaggttagtttgatattaaaattttaagctatataagtcacaatttgatcatcttagtaaatgcagaagaagcaaacagcaaaattaaactctcactcaggatttataaaaatctcagaaagctaagaaaacttttgggttgattaaaaacattctgtctcttaattgtggtagtagtttttggaatgtatccatttgctgaaacccattgagctgtacacttcaaatgggtgcattttatattatgtcagttatattccaatatagcttgctaaagaggaacctcacagggaatattgtacttaattttgcaatgttagaactcttcctcttaaatttggtcaaatgaaaaataaccagcaccatcactacttgctgtaatactggagaaactttcaatggtggctaagaaaaaacaagtgaaatttagggctccaaaagagaaaacaaaataacattatttcacaggcttgacaatttacttagaagagcgtaaaataatctacaaactgttgcaatgcataaaagaatttagcaccattacagcctcaagatcaaaagtcaaaggtcaatagcattcctatgtcaaaataaaaaaaaactaattaatacatagtcatagtctataataaagccatatgtttgaactattaacaaaattattatcaatttcctgaaaataactcttaaaatgatatggacttttatgtacaaaacaaagaaactttatcaaagtacttagctggggcctggttttaaggcaaaagtggcttttgcaaatcagtaagaaaatgtgattttaagaagtaattttatattcctatgtcataccaccaaagaaaaataagcttcaattttatttaagattcaaatgttaaaatgcaaaactttaaaactacaataaaaaaatcctgggagaaaaatatcactgctctttgaactttccaaggacactcataccacaggaccttcacacgtgctgctccttttgtctgaaatgctttttcaagatgcccccgtgccttgttccctttcctctgtcaggtctctgctcatttgtcatttctcagtgggactttcctgaatcagtccatgtgaaataataccccccagctccagcactttttctgcccctatgtatctctctgtttatcatcacctgaaatatttacattttttttaaggaaggagctttgttttgttcactgttgcatcctgagaatctgaaatgaatgtattttgaaaatataaagggaaaaatagcaaatgccaatacttgttatattcaagttatgaattttagtagttcccaactagtttcatagcatatatgctgtttcttgttttctgttttcaatatgtttatgattgtaattaaaatgaagaataatataaaagattgcaaggatgttacatgccagaaaataggttaatattattcagtgcattaagagatgatagctaagaaatcatttggatgttttgatgtctggcaaaaaagtcacttgataaaatatagcacctacttctgaaaaattaaaagcaaaaataaattccttaaaatataaatatgtaaagatttgaaacttgataaaacagaaagtcaatgacactcatcatataattttaaatttgtcatccattgctattaaagtaagcaaattgctatgcaaacgaattttgaaattctaaacaatgcaataaaatatgaaaaacaaataaaagtctaaatatttgtagtgaagccatgactctaattttttggagaaataagtaaattttttcagataaatccatggaaatcaactttagagcttttaaaactaaaatgttaggaagccatttcactggtgactgcattgaaatcaatgattttctgatgtccaagcagtaacgaatgagaagttccagatagaaacaaaccatctacaaggagccaacaaaacaaaggtatgcacacacacagagcaaataagctacaaaacatttgaagataatagtaagcacaaatgctcaagattgaagaagagcattcaagtttagttattcatgattatattccccaggtctgccatatattaggtgcttaatgaatatttaaggaatgaatacatgtagaagaaacacctaaatatgtgtagagatttaatcagttcttcactggaagacccaacgttaaatgaagtatattatttccaaaattatgtacaaattcaatgcaatgacgtttcatttgaagttgtgagccacatataaattaatacatggcaaagggatatttaaaacttgttgaaaatgtatttataatttggctgaccatttgtaaaaataagtcttttagttagatagcattaaataaaaataatgctatctagggtctctgctttatgcattcataattattagtcatttttatgaattggatagacttttatataaaaataaatgctaataattggaaaatatttagatttctggtgtcattttcattttattattttaatagaaaagcctatagtgattcagccttaagtatgacattggccattggtataagaaaaactatactttagattgcttattatctatttcaattttacttataatacattttgtcattgtttattcctaaagaattttctgttttcatcatatctcttttgaaatactctaataggatattttttcttctattttcagaaaccaaagtatcactgttttctgtttactgtcagcatttataataaatcagaattttatcaatccagtaaattaatgaggaagccagtcttgtattgtttaaataacttatatagtttagaaattatctataccttccaagatcaacgttctatataaaaataaaaaaccaccagtgattattcctaaatcaagtacaattgaattaaaggcaataaaaaacattaaagagagaaaatcctgtccattttgtacaaataacaaatacaatgcatagtgctgatataatcattatgaaattttatgtgccaaataagtaatattaaactatataaagcaaaacgtgtaagcaataatatgagatgctgggaaataaagttatactaacaaccttaaccacgatattctttacttaagaaatatcaagtagataaaaataactttcacatctaagaatatgctaacaacacaacttatagcaaggagaaatttaaaagccataataataggagaatcattaagtcattatgattggtcaataatacagaatgctatgcagtctttaaaacgcacattccaagtgatgtttagagatatggaaatatcactggaatgtcatttttaattatagtctctgggaaattttaaagggacaggaaactatgaacaaagtgaacagtataatgataaatataactatttctcacttttatctcattttacatgtagtctgtctctctctctcacacacaaacacacacacacacaaatacacttcctatactagttccattttcttctccttcttccattctgacaagtaatcattatcaaaaatttagtgtgtatttttttaatccattttatatattcacttaatgtaactataaataatatgtagtgtttctttggtttctatttacatcaatggtaatgtattatagtaatatcagctattaattttcaattttataagatcacatttctgagatccattcacattggaatgtagtagctatagatttaaatatagatgatatagtatttaatattttgtgcttttgccttacactgcactttcatttcctgttttccacctcaagctaaaattttagcattttacttttattctttctattaaagtcttctttgcacataccaacttgtgcacatgttctagaattttctagaatatagacttggaaaaaaactactaggctttaaaggattttattttattttattttttatttttttgagatagagtttcactcttgtcacccaggctggagtatggtggtgtgatcacagttcaggacaacctctgcctcctgggttcaagcaattctcctgcttcagcctcctgagtaggtgggatgccgagtacctgagattacaggcacgcaccaccacacctggctaagttttgtatttttagtagagacagagttttaccatgttggccaggctggtctcaaactcctgacctcaagtgatctgcctgccttgtcctcccaaagtgctgggattacaggcatgagccactgcgtgcctggtctctaaaggatatctattttcagttttatatatactgccaaactgttgttttttttttaatgattgtaccaactcacacagcacagcctgagaggtccctttcctcacttctaagtctagatgtgttactctccaatttttttttttttgcatttggatggcagtaaaatgtatctcaatgttgtgctaattttcattttgctcatttctagtaaatttgtacattttcttatataattttggcctcaatgctctcaagtctacaccccaccccccatgaatcacagggtaatcaactctttccattttcttatgcatttgaccatttttgtacagttcttggcataacctggataataatttgtcttttatgtactatgcaaatattttctcccacacaaaatgggacttttaaaaactttgtctaaggtttcattttttagtgtgaaaatttttcattttgatgtcatcaaatatttcagtcttttcctttgaagcttattctttctcttgtgtgtttgagttatttccctatcttgatatcataaaagcctttccatctgatagatttgattttttaatattaatatttaattgtgaaaataggaaataatgtatttctgagtgactataggagttattttagatatatggagaacaattaagacaatctaatatactaaatatttcaatatctcctcacttttataatgctaccttatttatataaaatgttggatatgatcattttattcactataattttataatgtcttcacagctgttcaagtcagttttccctcaattatcttcttctactatcttataaaattcaaaattgtcttgactttttgaatattattccacatgcattttagaattaacacgtcaagttttataaacaaacttttactttttggcattgcattgaactcactgataatttaggagacagtttgtatttgctatggctccttttctaaatcactccacagtaatcttacaaagagcattttcaaagatgtgtttcttcccacatgtttaattaatttactgtgattaagaatgagactttcggccgggcgcggtggctcacgcctgtaatcccagcactttgggaggccgaggcgggcggatcacgaggtcaggagatcgagaccatcctggctaacaaggtgaaaccccgtctctactaaaaaataaaataaaaaaaaaaattagctgggcgtggtggcgggcgcctgtagtcccagctacttgggaggctgaggcaggagaatggcatggacccaggaggtggagcttgcagtgagccgagattgtgccactgcactccagcctgggtgacagagcgagactccgtctcaaaaaaaaaaaaaaaaaaaaaagaatgagactttcaaaatgcattttctcattggttattgttgatattaatatgtatgaattctcttaatttttgagttatacataatatcttaaattcagacacttttctggactatcacaatagtagttttaagaataatacttttaagaaatgtatatagttgtcttaatagatttaagaaatgtatatagttgtcccttcatgtccatgggggattggttccaggacccacagtggataccataatccgcaggtgccaagtcccttaaataaaatggtggagtattggcatataacctacacatggctgctcatagactttaagtaatctctagatgatgtatatacctattaaactgtaaatgctatgtaaacagttcttattctgtattgttcttatttgtatttttattgttgtttttattttttcagaatattttcctgcagatgtggaacttacatatatggagacccaatggaaacctcctgggttttctatgcagacaattatgtctgcaaataatgagttttctaaacaaattcctttctgattttttttttgcttgtcttattacattgcctaggaataacattattataatgagtagaactagtgataacagtcttttgtcttttttgtgcatttaatgcaaatgctcatctttactattaagtgtgctaacagctgaagttatcaggttaatatacttcaccaggttaagaaggtttgtttctatttctgttttgttaaactacaaaaaaaatcataaatgaaaattaacttttcctcttgatttatcacatttatttaaataaacacagttatgatttctcttttaatctactaaaatgttggagtcttctctaatgttgacccatcattacatatctaagatgtctgagaaatacacatttgaggtaaattctacttgtttatggttttgtaaccataccagacaaacctgtttcaacttttatgtaagaaagttgtgagtttttcagttgctatggacccccacacattgacagtcacataacctgagcatgcccagttgaaccaactatgcaaccacagttggaacttaagtgctcagaccaagaaacagggacttaattaagacatggataccacatggaacaatccaggatccaatcagatcaagacttggtgtcaccttatagcaggatcctgtcagatcaagagatccatgcctagtggaatcatctgatttaaaaatccaatcaaatcacacctcattactctatagctataagacctgccccagctctccagctcaaggaaatggatttgagcctttcctcctatcttcttgccagtcagcttgcagagaaccttttcttttctccaaagccagtgccatgacattggcttgtatgggtatcaggcagtgagcccactgattgtttggtaaaaaattttaagtgacatttaaaattttaaataaaatgtgaattttgacttgctgacacttatcttgggagttctccatgaacgttcataattctgattgacctataattttgtcttattgaactgcccttgccttagtctggtattgatattttaatattctctcaaagacctgagaagcttttcctatttctttactttctgaagcagtttataaaataagtggattatatttttcatcacgtgtagaaaataaaaaattcttggccctagtatcttaacatttttctaataaaaattaatttttattataaaaattaaaatttgttattaaaaatttaattttttaattgtaaaaattttttattataaaatttaaaaaattattacaaaaattaacaattttttattatactttaagttctggggtacatgtgcagaacgtgcaggttttttacatagatatacacatgccatggtagtctgctgcacccatcaacctgtgatctgtatacattaggtatttctcctaatgctatccctcccctagcccaccaccccctgacaggcctggtgaatgatgttcccctccctgtgtcaatgtgttctctttgttcagctcccacttatgagtaagaacatgcggtgtttgattttttgttcttgtgttagtttgctgagaatgatggaaaaattatgataaaaaatttaaaattttcattataaaatttaaaaattttataataaaaatttaaaatatttattattaatttaatgtttatctttttataatgacctttttcttgttgattctattttggaatttttttcttacatttcccattttgtctaactcttctcatttactgccatgaagctattctgatatctgaaacctctcttgacctattattatttattcctctccatttcttttcataattaatttataatttcctccagttttttttcttgatctgtttggtttatttgtattagtcttttctgcagactgtttatggtttcactgaccatgtctaatactatgtatattttaaaaatttatttatgcttttctattatttccctccttcagctttatttacttttaaaatgttttcctagtatttcttaactgaatgcttatctcattaattttgaatttttttgtttctaaaagaattacattaaagagctgcaattctctttaaatgttagtttagctgtatccctcaattatatatataataacttcactttcattaaattctaaatattttctttattatatcatttccttttcttttcttgtaatttatgatgtttgtcaggccctgcaaagttaatgatgttttaacctttcaattctttcatggctcttcatcaattgattcatgtctgctcccttagcctatgtgttccccaatggcaggaattatcttcatttaatcccctgcctaaggccctggtatagtactgggcataccacataggcatagataaatagttgtcaatttcttacacccattcatacattgattcattcataaatgcagtcattcatttaatagatatttcttgagtttctgagaaggttataaaggtaaatgttctaggcacttagattggttatactctgaatattgctggcatctagtaatctgcgacatgatctcatttgtttaaaggtgtaattcaaatatcagccactatacagataacattattttcccataattatttcccccagatctttcattttgttattttggcttttcgtggtagaatcagagtccatcttataaattaataatgcagcatgccatgttgaggtgattaaagaagaaactgtagacccttttaacttttccttttgcttggatagacatttaagtctgtttgattttagttggggtttattttttgctctgctgccattggaatcatttaggatgctttttaaatcactattatttgaacacgagcccagatttaaaaaggcaaaaatacaagataagtcagatgtgggcctgggcaatgatattttgtcaaaggctctcaaatgattctacagtgtacttacggctgtagcaattgaaaggtatttattgtttaagctatagcttacagcctccttatacttacgacatttcatttactatttctcttatggtttctggggaattcaaacatggttgagattgcaagttttatacacaggatgtgcaggcattggtaaaaagattttcatgttgctttaaagtaagcatgccttttataaaaatgtactgtctattcatacctgagatgaagtaccggccaatctgaggctctccctgtatctgagaataaagaaacagtgtattagaaccctgcaggttccattccagatagacaggtgaggtcatcatggtggatgtctcatgaaggcttccagaaacctcagaaacctaaattagttcttcaagcatttggaatgctgctgctctcgtaagcatttggaatcctgctgctgtggtcaagtagtgaggctgactccaagaagagtactttttcatattttcattattttcaccactggagtgaacaccaaacttctgagtcttgggtaattatgaatatactaacttgggaccaaagggtgaggccatactgtccttgccatttggccattagaacttaataaatgagcccctattattaaataaataaaatacaatgggcttgtacctccttgccatactagttcaattttaactactttattaattgaaatatcagcagcagtagggtgctaactgcccagattttaccaaagagtcactaaccattgtggaagtaacttgtgcagtctgcaagtcaggcccatcttataagtcactgcatggatagttttcctgcagtcaccagcaaacctgtgatattaagggtcctcttccctcagtagtcattttctgttggatatccattccaatcaactgctgtatccttaggtaaccttaatttttcttgacaataggcatttctaaaatcctaactaactgtcacaaagaaggtacatgttatggagctaacacatttttgaagaatcaaatgagtgctaaggaaggcagggctaccattgtttggaggaatcatctgataagtatttgatttcttccaaatgataagtcctgtctcctttctgattcacttttttttgaaaaacgtataaaatgatatattttgggctcaaataaggtcagttagaaatagctggactcatacccaaatagtttgttctagttgtgactaaaaccctcagttgaacttttctccttaagagaaaaataacaactctctatatagacatggtgatttgaggaaattctctgatgtagctaatgtaaacaattatgtatcattgagtctaggaaactggattctccaaattatttctcttgtaaaaatgtatttgttaagtaaactgtagtccacaccacttcctcagccttctccaaagaaacacactgcttgaacaatcaaaggattacaaatttgaaagagaaattaaagttcatctcactgaactcactaccaacagaagtcaccatttattctgaaaaaatcaagattatttcccagggactgttttgcaactagcattgtatttagggagcttgaagaaatatatgcatttattcacattttaactatatttcttggcattctttctgcatccagaatttttattttcttctttttttccaaatagcaaacaagctttgatcttatatcagtaaatttattcccaaggtgtcttagtcgattttgtgctgctataacagaataccacagactgattaattgatagtgaacagaaatgtattggctcacagttctggaaactgagaactccaatattgaggtgctgacatctggcaagggcctttttgttgcgtcattacgttgcagggggatcacgtggtggaaaggcaaatagagggttagagagagacagaaaagggaaccaaacccacccttttgtaaagaacccactgctttgataacagccttaattcatttgtgaaggttgagtcctcatggcctgatcacctgttaaaggtcccgcctcttaacactgttacaatggcaattaaatttcaacatgagttttggaaggcacaaacactcaaaccatagcacaagagtaagcagaaaatatgccagaaagcatgggaaaatattactaaagactcatgtcattagtatacaaatgaaaagttttcacttctgtagttattgtaatccaagattctcaaacttcgtagattgggaggatttgattttatacattgtcagttcaatgttgatttggctagaaagatttgatgttacttgtttaactatttgaaactgagtgctatctgtggtccttgggtgcagtggagggggaaacgatctgatgaactcatggaggaacataggttctgagaatgagatgcctgattgatacctggctgaggacttgcatgcttgttctaaaatgtctgttcagttgacctcttcaagcttaattcacactacattgaagacaaatcagctcttcctcgtgtgaggtagacatccatagaaaatacctgagttatcttatcccagggataagataatctatctgcatgcccaattcaagtttgaaaactcctatcttagattattttgagagcttacatcttaaactttagattttaacaagagagaacacattaaatttgacaaaaaatattcattcccagaagatattgcaaaagatttctgatccttatattcactagttattgaaattcatatttggtttgtcctttgggcatagagttgtttgaactaagaataatttattaatttagaagacaccaattattagtttttagaacagacctactctacaattttctaactttgatgattgatacatctccccagaacctgccttaataatgactactcaaaccaaagatctggcattgttaaaggaagaagtaaaccattttttaaaataatcagaatgtgtttaaagaaactatactcttaaaaatattcatttttaatgagggccatggaagttcatcagcttcagagtcacatgcaatccgaccctgggtggttacacttgtcccaaaatctgaacctcctctgtgaagcattcgagacagaaccttgttatttctcagactttggaaaatgcattgtattgatgttatgtaaaaagccaaacctctgttcagtgtaaatagttactccagggccaacaatcctagtgctttccttttttaaaaatgcaaatcctatgtgattttaactctgtcttcacctgattcaactaaaaaaaagtattattttccaaaagtggcctctttgtctaaaacaataaatttttttcatgttttaagaataaaatatttatttttgaatgtggtagatgaaaaactacatgcaagatatttatctcaaaattatcaaaagtcattgagtatttgtgtgcatgtggtaagtgtatatatgtgtacatgctcagtaactatggaaacaaacaaaataagtcctaaaattggggaaatctttgtttacccagtggagaaagaggaggaactgaccctaaataaggaagtcaaaaatgtaacaatacagatattttgaagggcaccaaaaattgagccagaaatctaagtaactgagatgattgtaaataatacacaataataaatataaagcatataattataaaaccatatacaactatgttcctaattttgtcggcttttaagaaagcttgttttctttagtgttttcttctctaggaagcttaggaataactacatttacagctcacctattgcaattgccaatactttatgatatatagttctgagtaggactcagattctatccttcaaattgctaaccaatggcttccattgacttaattattgttttttattgcatctttaaaaataactgacacacattcattaagaaaaaataatgattatatgtaaataaataatacattatctgcctttgtatacatctatctaaatataatatctaggacctttaattgctaataaataagcatgttgccttctttgcacacataatatgtatgctgataatcttacaatagtacgatatttctattctgaagaaggctttaccatattcaactatttaatctcaggaaggtagtttacctctaatatatcaatagcctctaactgctctttgatgcccacaacaagttgagacaggcagagcctcaaggtggtttccctagaataaacattgagtgaaggatgtgaaggtgagtagcttatttgggagatgatctcagaaagcacagcaaggaaatgagaaaagaaaggaaataagacagtacgggatgcacaattgagtccattactgctcattatcctagttgagtaactagggctcaacctcatgagggatatctgttgatggttacagtacagagatgttatcaaaagggtgaggtagctgagctatttttctaccaacttcaatctgtcattgattgaagactgttacaagggtcattgattccttgacacttgcagcctgtcttatatggggggttaagcccactcccaagctctctaaaacatctgttgcaggtgttttcaggaagaagcctttagtagaaaaagcaaatacctaggagatatgaggaaggcaccagcaatgactgttatagagaacaagagagagaactggtgacaaaggcatcttcaaccttcctgaattcatcctttgcatagtttgataacatattattcagtttgctttgtagaacagacaggaggtgaatagtggttcaaatagttaggacaatggtatccttttttggctcttttaattataaattatattcttaggctatctgacatattcagacatcagtgcaagaaaatatttcaaagtcaaatgtaaacacctcttagatctgccactggggtatattcctgctccctctttttcatagcgtggtttctggagagccagatattatcaagtcgtgacagctatgagggcaaaggagaaatcaggaatgagttttttacacactctttctgcagttatttctttccgtactttctataaggcaccgtgaaccaaattccatctggttcccatgcattgtaacactttagatatctgcctcagacttctctggagataaacttctggctaacttgttttaaggccttctgtcctgatccttttatatctccaacagtcagcttctgtcaaacttgtgggaaataaaggattttacagatgctgataaaagatcagaggcacaaacctagtttaaaattccaaaatcgatatttaaaaaagggatgaaaacccccaggaaacccctaggttgtctaagaagtcctcagttcaaagatggtaattcagggatgaatctaaggatctgagtgtcaataggatctaggtttgataggaaaagaacgatctttttcaggatgccatggggactgtttgactttatgaccactgtacaaggtgaaactataagcgaggcagtggggccaatgggaaattgtgcagaggaaaatcatccattctacttttctctaatgctcagttcttaatttttctggaggaaaaaacaaacagagattagagatctcatcggtttatccaaagattccattttaacacacagccaaattaataaggtttaaaatgaccaactgaataaggagacagctgtatatcttcaagatattgtatatgatcttcaaggttaagagtaagggttgaggtgccatttttgtggaatcttctagaacctagattgcaagggttacttttctaagcaaatgtcttcacctgtagatttggcctgattttgtcttaagccaggtgagacagtctgactgttacaggatactggtgtcagacacacgttttccttaaatctgttaaggccacttgaatctgagacttcgttttccaaccaaattatcctgttcctctgtggatctgaaatcctggtctgaacagtagctcttctgcctttaccttgcagacagtttctccaacatttaggttctccccacgcccctaacttcctcatgaataagcaacttacctagatgtcagtgctggtatctggagtctttctgatgtctgcatgttcctggaatatattctcagtacaccagcgtcttcatactcatagtctttcccagcttttgaaacctctacaagccaggttttcagtctctaatctgtctgtatgggactagccagctgcccatgatgggataattcctgcagaccaatggctcagaactcttgactgcctttgttgttcaggtttcaacacacctggagtctcagtccgacatgtttatgctagagctccctatgacagggtgatagagtcatttgatggtcccaggataaggatgttaaatccctggcacttatgacactactccttgtttctaaacagggattgacaaagactttttaatcaattagtgtgcacttccacacccaggccagacatggtcacatggttttcctcactttattattttacacagctaattcccagagatatcagttaaacaaaacccacattctatccctagtggaaagcttgctgctaaggccagtgcttaggagagagggcaccacaagttgactccgaatatgagtttctggggagggacaacatcgctggaagcatgagacagggagctgactggggagagatagaaattgaatcacattgaaggataactaggagcagaatctctaaatggcccaatgacactcaaattcttggttttggccacactcaattcttcagcaatcctggctcagcagttcagggtcagagaagcagagagcagattgatccaaatatgggaagtcccagtagagcaatataaagagccacaaatgaatatattgggaggtatctcaacacttcctattgagtacggaacacacagcatggcactaatcttagtcatggtggtgagcacagcttatcaaagagctatagtacctcttaaagaagcattttgccaagcttaagatgtggctcccctttatcatggagaagagaaactgagattcaaacaggattgctttaatgccacattaataatggccaagtggatctaattgtaaacttgcaatgtttgtttatgtgagtcctacctaatttccccaggatcttctgctcccaaatttttagagctggagtcactactgctccaaccagtagacactcatgagatcctgagccaacattgatcaggcagggcatagaccagccatcatgcccccaacatttgtcagggcttggaataagtcattgtcttttttggagaagagggacaattatactcttttcttcataattacaactctatccttgagattaggcacactcacattaattctgtccctctttcttattttttattaactcctctctatctccagaagaagaaaatcctttaaactgggtattcagagcccaggatattcttgggccttcatcttccagtagatgcttatcctgtgcctgatagatccaaaggcaagggaaagcttcatctttgtgtctttttatgtagtaaataggcctgacaggccctacctgcatgtccagctctctgctttccctatgattgggcaggattggtactgacatgtatgcttgccatttagcatttcacagagggaagtaagaggccctagttctgccacatggcctaaagaaagctcctaattttttaaacaaagaagctgcattttaagaggggatgttttcgagcatttgtcaaattttgataaactttaatttggtcactgttttgcttttgatccttgtctaagtatagccctcatggaagggaaccaaagaagagaggaggtgcaattggaaccattctgttgggttggtgcaaaagtaattgcggtttttgccattgcttttaatggcaaaaaccgcaattacttttgcaccaacctaatagtcccctaaacttactctggcctactcaagggtattctcaaacccataatctagtataggccaaactactgggctgctttctgtagcccttctcattgacttacttggtcgttgtctagtaagttaccataatgataacttatagctgatgttattgaatcactgcaaacattctctggaccaccaagctctaactagcaaagaaagaggttttgttaatctctacatttgccccttccccaaaaataaaaataaataaaaagtagccatgtaatgtcatagcgaattcatttgagcacagaagtaataagttcaattttataaaggttggtgcaaaaataattgtggttgaaagtaatggcaaaaccaattacttttgcaccagcctaatatgagtcaagcttcataagagttattggccatctgaagagctgtgttgagaaggaatctgataccataccaaagatcaatgtgaaatcatgatttgattaattaaatatgctatgaatatgagagaggggaaacgttatcatgagtgccaaatatttgttatttcatgcctagaatacaagcttccatggatgcatcagaaatgtggccaacacctacacatgttcagaaataaagtgtattttctttattacttaaaatatagcatgatcatatgtcacttttccccatggtggatggatttacacttgtagatattggttgacagcacctcatttcactctcaaatttgtcccagtttggacagtatgtatgatggtcagcctatgagattagttctactacatcctaagtccgagacttaaaattatagagtggaaggtaagagcctttctaaattatagtaaccctcctagggctcaaataaaattgcctggccttgtcaaaagttgacaaaaaatcacattcattgatgttaaacgtagtatatacatatagagaataatacttctaaatttttcaccatatggctcaaaattctattacactgtatgtttctagaatgcagggtattatgattttggcatacaatctagcattagaacacaaatatctgcttctacagtcactatgtgtctgagaacacagcactaaatccctagcttgcacgtggaagtgttaaaatatctccagaaacttaggtaaacaacacgaaactcaaagtgtacacatgcacacatgcaaatgcatattctttaagtggaacatattaggtttagcatttatacatgaagcaatataactgatgcatatagtacctatttctgaaacaagttcagcaatgtctcctccaaccctccaactccatttttaagtcccagaataaatgcccttttatgtctcagcagaagcccagccaattctgcaaatggtcttggaaaattgccttcagaatggagtctctccagggaaggtttactgtagaaaaagcagagatacatggggattttcaagatccagaaaaaggcaaaggaggaggtagaaggtaacttgaagcagatggcatccatttctctttacccagtagttctattcattattaacagcaacagtttccacttgtgtggagaacaattttgtattgatccaatttaacttgctaaatccacaagcccagggtctatattccaggcagtccactgtggggaaattattcctgttgggaacaatgattttctattttggaaactgaattcaattgaatctgacccgacaaatatctgagggcttattatgtaacacctctctctctttatattttattgtgccctgaagaaatactaaaattaaccaagtggaaaactataaaataagacatggtaagtgccatgatcagagtaaataattaacaaattgctcagatgttaggaagactttattcaactgaagtaaccagcaaagaattcaagaaggaaataccattttaaattttcccaaatagatgggtagatttttaatgggaaacaagagggactaccattcttggaggaattcacccagcatatgaaaaggcacacagggagagacttcaagaggcttgtgtttggagagcaagattattttactagattaagattacataaagtaccaaaaaactatggcatgtttgataaatttcagttcaatctatttgtgaaataatttatccaaagctcatagaagatattattttatcaccctataatctaaatgcacaccaatgagaatttgaacaagttgacactaaaatattccaaataactctttgaagaaagagaaagcaaaaactggaaaataatgagagtgaggatgctaccaatctaaggttattatctgtaggtaaagctttcttatcaggcaacgtcacatcaatgtatggttttactgaacaagaaagaataaaaaatacctaagtatttatatcaagaagttagtattaagcacaacaaattaagcataaagaaaaaaggatgaagcatataaaagtagaaactaatgaattaaaataaaagcaaagcaaacataaatggtgggaagagaacaacataaatataaagacaaatagaactgatcagttatataacatcagatattagagtaaataaatgataagaatctgatgcatccattgaggcaaacaaatgttagtgtcaaagacaagaatatttttaataaaaaaaattaccaaaacatactcaagaaaaaatatagtctaaataaaccaataacctgagaaaatggcagagagctgggtgagagaatttagcaagggccattgtgttttccaatgagttattagaaattttagaaaaatacactttccatgagaaaataatagttacatgccatgaaatattatgcaatgcatcccagttaaattgagtcatctggaagaatccaaataaaattgaatccaacaaaaccaggtaagctttaacccagcaatacaatttactagaatataaaaaccaagctctctccagcatgcaaagatacagccagaaagtagctgtctacaagccaggaagagggtcctcaccagaacctgaccatgtcaacctccagaactatgagaaataaaagtctgttgtttaagaaaaaaaaaaaaaaacagacaacaaaaacaaaaaacaccagcaccaatagcaacaatcctatagctttagtatgatatatcagtaggccaaaagagaaaatattatatttattttagtggcagaaatgacactttatataattcaattaaaagttaatattactactataaccagaatttttttatgataaaagataacttttttaagcagcacaatctagcataaaagtagaaccattctttcaaagtcaggaacaaggtgagaaatgttgctttattattttttaagcttgtttgtaaagttctagcaagggcaataagataagaaacaaaataattaataataattaagaagacagttctatcactattcactgaggatatgattcagaaaatacagaatcttaaaaaatgtttaaatttatgaaaaatataaattacctaaatatactaagaaagcctaaatatgaaaaagaaatataaataacccaatataaaatcaaatactttatttagtcaaaaacaagaaataatacaatgaaaatattaattataagggcaattatctgtatgttcatgaaattacacactaacttcataaataaaacctattaagtccaaactaataatacaatataattaaagtcctgattaacaaggctaaggtggggtttgagatcactgagattttaaagtaaacaactttttcctattcaagagaaagatcatttgtttattaacgtcagattctataaaattaaaatgtatgctatgatacttaatataaagaataaaagaatagaataggaaatatagcttctaaactagagcaatgtacattttacttctagtaaagtcttgataacacctatcagaccaatcctcccacagattacgactataattcctggtgtgttaatcggttttcacactgctataaagcagtgtgaaacactacctagactgtgtaatttataaacgaaagaggtttaattgactcacagttctgcatggctgaggaggtctcaggaaacttataattatggcagaaggcaaaggggaagcaaggtacatcttacatggcagcaggagagggagagaaagcaaagggggatctcccaaaaacttttaaagccattagttcttatgagaactctctcactatcacaggaacagcatggggtaaagcgcccccatgatccaatcacctaccaccaggtccctccctcgatacctcaacacgtgaggattacaatttgagatgagatttgggtggggacacagagccaaaccatataatctggacaaaaattaagccagccagtcagtaagcaaataaataagcaaaaaaactatctgaaagcattgaagaggactaaaagcaagcagatactgaagcttagctgacattttaaagaatcaaagagcatgggtgagttttcccttttaagagcttttctttgttggcagaattcaatctgaattgtgctatagggctacagctctttatggaaaacctaaagtcctactttcttgacaaaccagagaacaggtcactgggtgatatggtttggctctgtgtccccactcaaatctcatcttgaattgtaatccccacatgtcagaggagagacctggtgggaggtgattggatcatgggggtgggtttttctgatgctgtcctggtgctagtgagtgagttcccatgagatctgctggtttaaaagtgtggcactttcccctttctctctctcttgctgctgtgtaagacttgacttgctttcccttctgccatgattgtaagtttcctgaggtctccctagccatgtggaactgtgagtcaattaaacctcttctgtttataaattacccagtctcaggtagttctttatagcagtataaaaatggactaatacagaaaaatggtagtgggagtttggggcactgctataaatttacctgaaaatgtgaaaatgattttggaactgggtaatgagcagaggctggagcagtttggagggatcaggagaagataagaatatatgggaaagtttggaattttctagaggcttgttgaatggttttgaccaaaatgctaatagtgatatggacaataaagtccaggctgagattgtctcacatgtagatgaggaacttattgagaactggagtaaagttactcttgctatgctttaggaaagagactggtggcaatttgtccctgccctagagatctgtggaactttgaacttgagagagattatttaggctctctgggagaggaaatttctaagcagcaaagcattcaagaagtgacatgggctggatgcagtggctcaggtctgtaatcccagcacttcaggaggctgagtcaggtggatcacctgaggtcaggaattagagaccagcctggccaacatgatgaaacctcatctctactaaaaacacaaaaattagctgggcatggtggtgggcacctgtttcagctactcgggaggctgaggcaggagaatggcttgaacccaggaggcggagattgcactgagccaagatcatgccattgcactccagcctgggcaacaaaagcaaaactccatctttaaaaaagaaaaaaaacaaagaagaagaagtgacctggctttttgtgaaagcatacattcatgtgttcacaaagagatggtctgaaattggaacttatgtttaaaagggaaggagaaagcagagcataaaaatttggaaagtttgcagcctgaccatatggtatgatatggtttggctttgtccccacccaaatctaatcttgaattcccacatgtcgtgggaggtacctggtgggagataattgaatcatgagagtgtgtctttcccatgctgttctcatgatagtgaatgggtcttatgcgatctgatggtattataacggggagttccctggcacaagctctttttctttgcctactgccatccatgtaagacatgacttgcttctctttgccttctaccaggattgtgaggcctccccagccacatggaactgtaagtccaataaacctcttccttttgtaaattactcagactaaggtgtgtttttatcagcagtgtgaaaacagactaatacaggtagaaaacaaaaactcattttccagggaagaattcaagcccaagcaggctgcagaaatttgcataagtaacaaggacaagaagccaaatgttaatagccaagacaatggggaaaatgtctccatggcattccagaaatctttatggcagccccttcatatcacagacccagaggtctaggagggaaaaatagtttcatgggcttagcccagggcccagatgctctgctcagtctcaggatacagtttgctgtgccccagccacttcagctccagccatggccagagggaataaggtacaacttgggccgtggcttcagagggtgcaagacccatgccttggtgacttccataagcaattgggcctgcaggtgtgcagaagacaagagttgagctttgggagcctccatctagatttcagaggatgtattgaaacaccaggatgtctaggcagaagtctgttgcaggtggggagccctaatggagaacctataataggggagtgcagaggggaaatgtggaattggagctcccacaaagagtccccactggggcactgcctagtggaactatgagaagagggtcaccatcttccagaccccagaatggtagatacactgacagcttgcatcagacacctagaaaagccacaggcactcaatgacagcctgtgaaagcagcccagagggggctatactctgcagaggcacaggaacagagcttcccaaggccttgagagcccacctcttgcaccagcatgtcctggatgtgagacatgaagtgaaaggagattattttggagctttaagatttaatcactgccctgatgggtttcatatttgtatggggcctgtagcccctttgttttggtcaatttctcccatttggaacaggagcatttacccaatgcctgtgcccccactgtatcttggaagtaccaagtgcttttaattttataggcacataggtggaagggaatcaccttgtctcagatgagactttggacttggacttttgagttaatgctggaagaagttaagactttgggggactgttgggaaagcatgattcatttttaaatgtgagaatgacataatatttggaaggggctgggcagaattatatggtttggctctgtgtctccacccaaatttcatcttgagttgcaatccacatgtgtcaaggaagagacctgtggggaggtgattgaaccatgggggtggattttccccaacctgttctcataatagtggctgagttatcatgagatctgacagtctaaaagtgtggcacatcctctcttgctttctctcttgccaacatataagacatgccttgtttccccgtcagccatgattgtaagtttcctgaggcctccccagtcatgcaaaactgtgagttaattaaacctcttttctttataacttacccactctcaggtagttctttatagcagactaaatacagactaatccatggggaaactggaaagcaaggaaggaaaacctcagaaaataggaaagattttaaagcagctattctaactatgcccaaagacataaagtaaagtatgctcataataaataaagagatagggagtctcagcaaatgagtaaaaattacttaaaaaagggaattctacaatggaacattacactacctaaaataaactattggagaatgaggaaatggaaatagaaaaagacaaaacaaaaattaattcattacaaaagtcaaaaaggaaaagaaattaaaaagaataagcagaacaaatagcagtcatagcaaaagattaaaaaataaatcaaattgaagccacaaatgtaaaaggaggaaactctccatataaaacatgacaattatcaggcttgaataggtagatagaaagatagatagatagatagatagatagatagatagatagatagatatagatgaaatagatagatagatagatagatagatatagatgaaataaagacacacaactgaatccaattgtatgaaaatcaattgaatactggatttgaaaagcatagtatctactggaacatttttggaacaattggggaaataaaacatggacagaatgttagataatattgctgaatagatgttaaaaggtctaggtataataaaacgtaaaagatttatatgatctgaaaagaaaccagagtatagtctagatattacaattacattgtgattatggaagagagtgactttattcttaggataaacctgtggaagtatttagggaaaaagttaagttatgctttcagcttacctctaaatgattcaacagataaaaatgtaccatatttggaaagacagtgaaacagagaaggtgggggagagaaaacaaatgtgacaaaatgataataaatggtaaatctaagtgttggatttatttgtattatttcagtttttctggttgtttgaaaatatttaatataaagtattgagaaaagtaaatacatgttagtaaaaagaagcaagataataaaacctttaaaacatcattgaaaaatattcatgtatatgctcatgtgggggtctatgctattcccaagagatccagataaacttcctaaaatttctaccacctaaccctttttttttgtttgttttgttttgttttattttgttttttgacagggtcttgctctgtcacccagtctggagtgcagttgcccaatcttgctgatcttggttcactgcaacacttacccctcaggttcaagtgatgctcccacctcagcctcccaagtagctgggactacagcacacaccatcatgccctactaacttttgtatttttagtagagacagggttccaccatgttgtccaggctggtatcagactcttgagctcaagtaatccacccaacttggtctcccaaagtgctgggattacaagcatgaaccacaatgcccagcctaacccaattctaaaataagactttaggagagtgaatttattaccactgaactgtacaattagaagtggtaaagatggtaaattatgtatgcatattttacctcaataaaaataaattttgttttattttaaataaaaacaaatttaaaagagcgtaaagaaatttaaaaaaagattactcatatcttactttcatctgatttaggatttactcttgaacaaaactagttatgagttaactatatcatgatattgaccagttctagttgtgaagtgatttttatgttgattcgaaatctatctcaccattttttcccactcttattatgtgacctttgacacatcactatcttttggtatctgcagaacttaagtagttaagtaacagaaaatccaactcaaaataatttaacctaaaaaggaaatatgttggttgttgaacaaagtattttaagattagtgaatcatatatggctgtatccaagaactcaaatgatatcatttgatttcagtttctctttagtctcagctttcctctcttttggcatcctattgatggtaagatgtctatcatcctcttccaattcacattctctcagctaccccaaggtgaaaataagttatcttttatcgaatttccaacagaagttccaaaaacttgtcttatttacacacaacaaaaagatttatgctcattttacaaggacacaaagcagccaagtggaaggtgtgcttcctaaaacatgttatgggaggagggaggcagagcaacatggtggaatagaaggctcccctaattgtccccctcacaaggacaccaatttaacaactatctacacaagaaaaacaccttcatcaggtgagcactcacagtacctcgttttaacttcatatcgctgaaagacacaatgaagagatagaaaagcagtcttgaatcacccaccacacataccctacttcacctacagtggtagcatggtgcaaagtgtgtttttttgtgctgtcaaagggacagagcagcaattagcaggcactgaactcagggctgtcctgttatatagcagaaaggaaaaccagaccagactcagctcatgtcctcccctggagggagcacttaaaccagccctagccagaaaggaatcaccagttgcagtggtcagaacttgagttcctataaacctcaccactgcaggctaaggtgctatggggccctagtaaacttgaaaggcagtctaggtcacaaagactgcaacttttacccaagtcttagtgctgaactgggcccagaaacagtgaactagtggggcacatgagctaacaagacaccagctggggcttcagaaggagtgctaacatgaaccctcccctaactccaggctgcacagctcatggctccaaatgagacctattcattccacttgaggagaggagagggtagagtggggagaactttgtcttcatcctggataccagctcaaccacaacaggatagggcacaggttaaagttgtaaagccctctttccatgtcctagcccccagaggacatttctaggcacactctgtgccagaaggcaacccactaccttgaaaggaaggacccagaattggaagaatttatcacctgctaactgaagggcccctggtccctgaaaaaccagcagtgatacacaggtactatgttgagggccttgggtgaggctctgagaattgctggcttcaggtgagactcaaaatattcccatctttggtgactatgggttttcagaaaaacagagggcaaagtaaaggggactttgccttgcacttaggtactagctcagccacaggagagtagagcaccaagtgggttctgagagtactcaattccagaatttggctcttggacagcacttttgaacctaccatgggtcagaggggagcccactgccctgaaaggtgagtctcaggccagcaagcattttccacaagttgatgcaagagcccttaggccttcagggaacatcagcagtagtctggcagtactccccatggacctgtggtggtgatagcaatacgatgaggctcctttgccttctaaaggagacaggagagttggaagaaatgcatcttttggtttgagtgccagctaaactgcagcacaaaacaataccaagtagacatctaaggtttttgaatctagtccctggctcccaggtgacacttctggactcacgaggggacaagggtaactccttgccctgaaaggaagaatacaagactggctgacttcaccacctgctgattgtagacctccgggaccttgagcaaacataggcagtagcaggaatcggttaccacaggccttgggcaacacccagtgctgtacaggattcaggtctgaccaagtacagtcatagtgctggtggccacaggggggcttgtgtcactccaccccccagttttaagtggattagaaaagaaagagagagagaccctgttcatttgggagaaagtaaggaaagagaacaagattctctgcctgataattcagagaattcttctagatcttgtccaagaccatcaaggcagctcctgtacaagtgtgtaacaatcacagtattactgggcttggggtaccccctaaagcagacgcaactcagatcacaacagtcaagtaatttcaaatgtctaaaaagcttcaccaacagagacggctacaaataagcccagacagtgaagactaatataaatatcaactcctcaatgcccagatacagatgaacatctacaagtataaaggcattccaggaaaaagatgacctcacaaaatgaactaaataaagcaccaaggacaaatcctggagaaactgagatatttgacctttcagagagagaattccaaatagctgttttgaggaaactcaaagaaattcaatataacacagagaaggaattcagaattcaattaaataaatgtaacaaacagattgaaataattttaaaaaatcaagcagaaattctggagctgaaaagcacaattggcatactgaagaatacattaaagtcttctaatagcagaactgatcaaacagaagaaagaatccatgagctattagtgagtttaagataagctagttgaaatgacagagaagacaaaatagaaaagaataaaaataatgaagcatgcctacaaaaactagaaaaatagcctcaaaagggcaaatctaacagttattagccttaaagagatggtagagaaacagataggggtagaaagatcattcaaagaagtaataacagggaacttcccaaaccccaatatcttatactttgatatatcaatatccaactacaagaaagttatatagcatgaaggagatttaacccaaagaagaaatacctgaagaaatacctgagaagcatttaataactaaaccaccaaagatcaagaataaataaaaaatcctaaaagcagcaaaataacataaacaaataacatacaatggagctccaataatttggcagcagacttttcagtggaaacctgacaggccaggagacagtggcatgacatatttaaagggctgaaggaaaacgttttttaccctagaatagtatatctggcaaaaatatccttcaaacatgaagaagaaataaagactttcccagacaaagaaaggctgagggatttcattaacactaaacctgtcctacaagaaatgctaagggggtacttcaatcaggaagaaagggacgttaaagagatataagaaatcatatgaaggtacaaaactcacttgtagtaagtactcagaaaaaacacaaaatattataatactgtaactgtggtgtgtaaactactcttatcctaagtaaaaagactaaatgatgaacccattaaaaataataactgcggttgggtgtggtggctcacacctgtaatcccagcattttgggaggctaaggcaggcagatcacaagatcaggagttcgagatcagtctggccaacatggtgaaaccctgtctctactaaaaaaaatacaaaaattagcagggcatggtggtgtgtgcctgtaatcccagctactcgggaggctgaggcaggagaattgcttgaacctcgtaggcgaagtttgcagtgagccaagatcgtgccattgcactccagcctggggacagagcaagactccatctccaataataataataactacaagattttaatacatagtcaaataagatataaatagaataagtaaacaaaaagatacaaagcagtgggatgaagttaaggcatagtttttattagttttctttttgcttgcttgtttatgcaaacagtgttatgttgttatcagcttaaaataatggattttaagatagtatttgcaagcctcatggtaaccccaaaccaaaaaacaaacaacagataaacaagtaaaaagcaagaaaataaatcatatcaccagggagaatcaccttcactaaaggaagacagaaaggaaagaaagaaagaagagaagactacaaaacaaccagaaaacaaataacaaaatggcaggagtaagtcctcatttatcaataagaaagttgaatataaatggactaaactctccaatcaaaagacatagaatggctgaatggatcaaaaagaaaaagacccattgatctgttgcctacaagaaacatacattgcctaaaaagacacaaaagggctgaaaataaagggatggaaaaacatactccatgccaatggaaaccaaaaaatagcaggagtagctatacttatataagaccaaatatgtacccaacactggagcacccagatatataaaggaaatattattagagctaaaaagagagatagcacccaataaaataataactgaagacttcaacatcccactttcagcactggacaggatcttccacacagaatattgacaaagaaatgtgtgacttaatctgcactatagacccaatggatccaacagatatttacaaacatttcattcaacagctgcagaatacacattcttttccccagcacatggatcattctcaaggattgaccatatgttacttcacaaaataagtcttaaaacatttttaaaaattgaaataatgtcaagtaacttcttggatcacaatgaaacaaaaccagaaatcaataacgaggaatttgggaaactatgcaaataaataaaaattaaacaatatgctcctgaatgacatgtggttcaatgaggaaattaagaaggaaattgaaaattttcttgaaacaaatgataatggaaacacaacatgtcaaaccttatggaacacagcaaaaacaatactaagacagaagtttaaatctataagtgtctacaaaaaaaggagaaaatgttcaaataaataattgaatggtgcattttaaaggagaaaagcaagagcaaacaaacccaaaattagtagtagaaaaaaaagatcagagcagaaataaatgaatttgaaatgaagaaaacaatacacaagaccaatgaaacaaaaagtcagctttttgaaaatttaaacaaaattgacaaatctttagctagactaactaagaaaaaaagagagaagatccaaataaataaaagcacacatgaaaaaggagacattgcaactgatgctgcagaaattgaaaggattattagtggccacaatgagcaactatatgccaaaaaattggaaaatctagaaaaacagacaaattcctagacacatgcaacctaacatgattgtaccaggaagaaattcaaaacctgaacagaccaataacaaatagcaagattgaagccatagcaaaaagcctcccagaaaagaaaaactgaggacccagtagcttcagtgctgaattctaccaaacatttaaagaagaactaataccaatcccactcaaactattctaaaaaatagaggaggaggaaatacttccatatatattctacgaggccagtattactttgataccacaaccagacaaagacacatcaaaaaaagaaaactgcaagccaatatcactgatgaatataggtgcaaaattatcaacaaaatactagaaaaccaaattcaacaatacattagaaagatcattcatcatgtccaagtaagatttattcctgggatgcaaggatggttcaacatatgcaagtcaatcaatgttatacattgcatcaacacactgaagaacaaaaaccatacgatcatttcaattgatgctgaaaaagcatttgataaaattcaacatcttttaatgataaccctctcaaaaactggggatagaaagaatatatctctgtataataaaagccgtatatgacagatccacaactagtatcatactgaatgggaaaaaactgaaagcctttcctctaagatctggaacatgacaaggatgcctacttttaccactgttacccaacacagtactgaagtcctagctagagcaatcggacaaaagagagaaataaaggtcatccaaattggaatggaagaagtcaaattatccttgtttgcaggtgatataatcttaaatttgtgtgaccttaaaggcttcacacacacaaaataaaactactaaaactgataaaagaatttagtaaagttgccagatacaaaatcaacatacataaaacagcaacatttttatatgctaatagtgaacaatctgaaaaagaaataaaaagataatcccatttaaaatagccacaaataaaattaagtgctaggtattaacttaaccaaagaagtggaagatccctataataaaaactgtaaaatactgatgaggccgggcacagtggctcatgcctatattccccgcactttgggaggctgaggcaggtggatcatatgagatcaggagttcaagaccagtctggacaacatggtgaaaccccatctctactaaaaatataaaaattagccagacatggtgacaggagcctgtaatcccagttacttgggaggctgaggcaggagaatcacttgaaccctggaggcggaggttgccgttagctgataatgcgctattgcactccagcttgagcaacaagggtgaaattctgtctaaaaataaaaaaaccgatgaaagaaattgaagagaacaccaaaaaattaaaagatagtccatgtttatggattggtagtatctatctatctaatatatatataatttttttttgaaactgtgtctcactctgtcacccaggctggagtgcagtggcacaatctgctcactgctacctcgacttcctgggctcaagtgatcctcccacctaagcctcccaagtagctgggattacagtcatgtgccaccatgcctggataatttttgtatttttttgtagatacggggttttgccatgttgcccaggttggtctcaaactcctgggctcaaaaactgcccaccttagcctcccaaagtgttgagactacaggcatgagccaccatgcccaactcaatattgttaaaatgtccatgctacccaaggcaatctacagatttgaggcaatccctatcaaaatgttaatgacattctacacagaaatagaaaaaaaaaatcctaaaatttatatggaaccacaaagacccagaatagacaaagctatcttaaggaaaaagaacaaagccagagaaataacagtacctgacttcaagttatacttcagagctatagtaacaaaaacagcatggtactggcattaaaaacagacacatagaccaataaaacagaatagagcacccagaagcaaatccacacatctacagtgaactcatttttgacaacggtgccaagaatgtacactaggaaaaagtgtctcttcaataaatggtgctgtgaaaactggttatacatatgcagaagaataaaactagacccctatctcttgccatataaaaaaatcaaataaaaatggattaaagacttaaattttagaccccaaactatgaaactactgtaagaaaacgttggggaaactttttaggacattagcctgagctaaaatttttttagtaataccctgtgggtaatagtaataccctattaagttgcacaggaaacttaagcaaaaatgacaaatggaatcacatcaagttaaaaagcttctgcacagcaaaggatacaatccacaaagtgaagagatgacccacagaatgggagaaaatatttgcaaactatccatctgacaagggattaataaatagaatatataaggagctcaaacaactctatagaaaaaaaatctaataatcttatcaaaaatgggcaaaagatttgaatagacatttctcaaaagaagatacacaaatggaaaaccagcctatgaaaaggtgctcaacatcattgatcgtcagaaaaatgctaatcaaaactgcaatgagatatcatctcacctcagttaaaatggcttatatccaaaggagagtcaatagcaaatgcttccaaagatgtggagaaatggaaacccatgtacattgatggtgggaacgtaagttagtacaaccactatggagaagagtttgaagatttctcaaaacactaaaaatagagctaccatatgatccagcaatcccattgctaggtatattcccaaaagaaaagaaatcagtgtatcaaagagatatttgcactgccaagtttgttgtggcactattcacagtaaccaagatttggtagcaacctaagagtccatcaaccgatgaatggacaaataaaaagtggcacatatacacaatggagtactatttatccacaaaaaagaatgagatcctgccatttggaacacatagatggaaatagatatcattatgttaagtgaaataagccaagcacagaaagacaaacattgcatgttcttacttatttgtgggatttaaaagtcaaaacaattgaactaatggacatagaaagtagaagtatggttaccagaggctggggaaagtagtggagttggggtagaggggaatttgggatgattagggagttaaaaaaatataaaaagaatgagtaatacctactatacaatggcataacagggtgactatagtcaataacaagttaattgtacctttaaaaataattaaataagtatacttggattgtttgtaacacaatggatgaatgctcgaggggatggataccccattctccatgatatgattattatgctttgcatgcctgtatcaaaatgtttcatgtaccccataaatatataccccataatacatacacacaaaagttaaaaaaataaaacaaaataaatagaaaaattcgcaatcatagtttcagattttatcacccctttctcagtaattgatagcataattagactaaaattcagttaaattatagatttgaatgatactattgactcccttgattgaattggcataataactgctgaatacacatttttctccccaagtgtacatggaacattcatcaagatggctcatatgctgggtaaaataacaagtctcaataaatttcaaaagatccaaatattataaagtgttttctaaccaaaatggaattaaatttgaaattaataagctatttagatttttttttaaaaaaagaaatattacgggagaatgttcctgaaatctagcacatttcatactgaacagtaaaagactcacactccagggattcagtattttttctcttctgtcaattaaaggaatttgattgttaatttaaaaacccagtctttataagtatgtgattctgattttattgtaagtgtttgttcctggtggttttggttttggagcttgcatactcccacaccaagaccctaagagtggagctacaaaggatggagcctgtctccattcactttggaggcctgcagaaaaacccaacactgtttttttttttttccaagttggataaactcttaacgtttcacagtggggtgttgattttcctggccagcctgctgaactctggtaacacaagactgctggtccccagggaaccactatgcatagtatgcctaagatgtggcttggagctgcagaaacccaagtggggccttccgttttcagtaaagaccaggaaatctctgatggtgtcctacattcctctgcttaataccaatccctcctccccactaaagaccatgcaagtggttcatgtaaatcgccctggtctgcctgccaacattccaagtgcttcagaggaaatgtgaacactctgggtgcctaaattttctttgaaaggtcacgggcaaatgtgggctataaatgtcctggcattacagctggtctgctacccctgcttaggatacccagtactcaggctgctatactgaaaccttcatagatttagctttcctggatttacaattcaagccagatgcttatggtgtaagaaggagtggaaaggggtggtgagattttacatgtagggggaagataacgcagttgttaacaggtttgtcttttattctcaggagtgtagtctcatccctagtgcttattacatgccaggcactattctcaggaatgccctggtttgaaagataaattatatggttatcctagatataaagggcttatccaaagtagcacaggtaatcaacttcatattgcaaattcagatcacctaacttctctacagtgttcttttccctaagccataggcgcctctcatgaaaagtgctaccttcctctttctcttaaaagacctctctctctctacaaagacctgggacacacacttatcccttcctgcctctagcacagaaggtgaaaggctttctcagtttatttcattagcacctgagaaccattagttatgcttcaatggaagtatccgaactttagcacatgctaaattgaacttgatttttatctttcactgggaaatgttactgctttttgacaaaagaaggtaacttaatttctttgttggggacaaggggaaaattcaaaccttgtttttaggatctaacttcggcaaaatgtaaccagagtcttgcatatatgcatgcatgcacacacatacacaaacccctccttaatctgttttatctcaaccattgtgtacatagtggttgccagagatgaataactcattaatcttctttaagacaattagccagtaaattcaagctaattagctagatctgggttgagtcaagaaagctatttgttggaactggtagagaatttgtaggggcaaagttagaacaaggtaggaagaaagccaggatcagcagatgggagactccaagctctgcagggttgctacatagaattctcttcagaaatgccactggcctcaaggagcagcccaaaggtacaaggtactgcctcaaagatgtttgatttgcagaatactgtcaaattccatgtcttcattgtgccttctgtccttctggctttgaaggatagagagctggagtgagttcccaactatccccagctaggaaagaaggaagaaaatcaagcttcctcataaggaaagggaatttgagtgtctaatatgtactcttcactcattcatgttaagtagataacaaaacagagtcaaagaagacaggtgacaacccaagaccatccaagtagctagtatcagaagcaaaagactgcagccctgtactatgacatcccgttctccctgagagcatcctttaaagagtttgtggtgaatccaacctactaggacccagggagatcctagcgtgggaaggaaggagactcaagagcactgaattcagtgagctcttctgtttatcaataatatggctttgggcaagtcattccaattctctgagcctcatttttttcatttctatttgaggaaaatgatttctttgtcatagtcactgaaaacgttgggtaaaattatatgacgaaaacatccctagtgcttcttacatgccaggcactattctgtgggctttacatattataactcatgtgatcttcacaatatatctacaagctagctaccactaccatcatcaattaataaaggaggaaactgatgcatagggaggttaagttgagcagctagatagtgattcagagtggattcagacctggatggtctgatttgtgagcctgtgctttaattactttcctgccttttctaacttgcatactggcttaaatggagtttaataaatgctcctttaatgctgctgtttattcatccaatatatagaagctcaggacagaaaataggcaaaaatggcctgttagtatttatctctaacttgaactcaagatgaagagactgatccatgtatctttccccctgcccattacctgtttcaaaggatatagctgtcagtctttttcttggagatatagcatagagtttagcaaagacacagtgaaccaaagaaaatgcaaatctatcaaaatctcatagactccttttcatgtgtgttccaagcactaagagacacaagcatgcgataaggcctatctcaggcttgcaaacaataagagctcaaatcacacttattagaagaaattgaatttacatggccaactcaaaggggagcttgattctaggattacttcctttcaatgtctatttagaaaaaagtccccctttctccagatgctctcagaggaggggatgaaaaaatatctcctgttgggggatctcctgctactgactccatctccaaacatcaccctggaggttttgcaaattggcacagcacttatgaataatcagccacaaatgaagagtaaagacatgagctcttttttggaggaatttctttcctctagcttccagctgatcatttaagatggttcctggtccctcccacaaggtatgtcagcttacaagctcagccaatgtcctggacaaacaaaatctacttgaaacctcatcccagaaatcctgactttaagcctagctcgtcgtgagcattcctgctgcatggagataaatatgctctgtgtattatctcataagatcctcacaatgactttgtaaattcaggctggattattatctccatcttacagtaggaaaaaaatgaatggcaggatgattgagtaaatcactgcaggtgacatgcagtgtaaacagtgcaactgggttgtgagtttaggtcaatcccacacaatgcctctttctttaaatgagataaacccttgggtcaagcgctgtcatttccataaacttttatccaaatgtgaatgtctttgctgtaagacaaatcaggcaggggttattaatgtatcacattttcatcttccataatatattggattcagaaaaacttttacatcctaagttcttgttacactgttctggggtgcaaaatgagataggaatggaaaagtggacaacaaagaacagtgaagaaacttagaagtatcactgcatttccaattttgcctgagctagccctatcaaagccagtattcattattaaggaatcagagaggtgaaaagtatataaccaagatgaaagtggaggatttcaagggttaaagtctctatttactagtgaaggcaactactagccacttagaatttgggttattttgttgttgttattctgcatcctataaatgcagaatgaacatttatttgaagtgcaaatggaacatttaccaaaatggaccagctgctgggccataaaaaaagtctcaataaattgcaaactattgaaaccacatagagcatgttctctgactagagggattaagttagggatcaattaagcaaagaagataaataaaattcccaaaatgcttcaaaggaggcatttttaaaaatttaggtataatttacacaaaataaaatttactcttttcagtgtgcagtttgccagtgttggcaaatgcatacaagcatgtaatcaccagtatcatcaagatgtggaacagtttaatcccacacaaagttcccctatgtctcattatagacaactcctccctacgaccctagcctctggcaaccactgaactgatttctgtccctagaattttgcatttcaaatctggcttcttaaaatctcccataaggcatttgaggttcatctatgtgttgagtggatcagtagcatgtttcttcttattgctaaatagtattccattgtatggatgtgccacagtttatccatttacagattgaatgacatttggtttattcccagtataaggcaattataagtaaagtcaagataagtctttatacagagaatctctgggtctaagtgtatattcaacttaataggaaactgccaaagttttccatagtagctgtgatatcttgcattctcatcagcaatgtatgagggttcccattgcttgacatcctcatctgtgaagctcttcttagtttattaagtctttctaacaagtatgtagttgtatgattgtggttttaatttgcaattaaattactaatgatatttcatgtcattttgtcattggtatttatccattggtgaaatgtttattaagttcttttgtccatttttaaagtagactttttaattattaatttttgagagtcctttgtagagtgtagttatgagtccttcaggaaatatgttttttccaaatattttctcccagactgtgtcctgtctcgttttgttaatgaaaatgagcaaaactttaaattttatgaagtctactttatcatttttaatttttttatttgtttaatttttgtgttctatttcagaaatcactgtgtaccacaaggttgcaaagaatttcttttagttttcttcataatcttacaaaattatattccaaaattctcctttccatagtttatgcaattattgccatccattttacttctataaatgctatggacacctaacatcttgctattcctttttgctttagacagtcaattttcttttttgtgtgtgtgtggatcaaaatttctgtctagcatttcttgctgaagcgctttttagtatttcttgtggtgcagttcagccaataagagagtgtctcaatttttgtttgaaaaaaatatttcttctttatttttgaattttttgagtgtgggtctgggtgtaatagtctaggttgaaagtggttttgctttttttgtttgtttgtttgctttgctttcaggactttaaagatgtcacttgattttcttcttgcttgtgtagtttctgacaatatctgttttaattcttgtatatgttcctttgtatataccatatttttcctggtatctttaaatattttatctttatatatgattttcaaaatgtcgaatatgctggttgaagagtgtttgtgtgtgtgtgcacgcgcacgtgcactgtgtgcacaatatatgtgtttccttattgatcctgcctggtgtatggagtccccgggatttctgggctagtgtcatcttccacatttccaattacaccaattacatatacgtttgtaagatattttcccatggttcttggataatctgttctttttattttccactcttgtttctgtttttttatgtgtaaatttaaacaaactgttcaaaagctattttttatgtccattttcatttatatctaatttcatgtttataatttcttctaatttgtcttcaagttgactgaatttttccatggctgtatcgagtgtactaaaaaactcatgaaagatgttctttatctccgatcccatattttaaatttctagcatttatttgattctttttcacagtgtccatctctgtgttgaaatttctcatgtgttcatgcatgttgtccatgtttttgcactggaatctttgctgtgttgataatatttgttttatatttccagttgtttcattgtctggatgatattttagtctggttctcttgattgtctgtggaatgaagtcaattattacaagaatttcatggatgcagaaactgaggctcaaggaggttagatgagtactcaaaatcacggagccaagaactgatgaaatgaagtcaaacaaatttcaggctttatcttctgcccactaaactgtgctgctctataatatggacacaataaatagctactgaacaggtgattacatgacctggaattctcaagcataaaaatctgtccaatgttgcccaatagaaatgcctctggggacccaaatcttgggacacagctgagtgggaagccactaggagcttatacctatgttctgatggtgtagaactatttcaaaaccccatgagaatgtatgcatttggtaggtaagtgtcactgtggccaagtgaaaggtatgttcatctctttactcacttactcacctgcccaagcagcacaggatctggaacagtcagaggacgagactgcatggaaatatttgacataagccttatagacgcctctctcaccctaactcttcactgaaaaagcaccatttgttttttcaccgaataatcatttgtagcatacaaaatgagccatgtgatttgtttatttccttattaaaacaaacaaaaattcgccgccctgttctgtcccacagccagggctaccctggctataagccagctgtgtggctctgcaatttcaggcactggaatgagctgggatggggcctgcaggctttttctagctccaaaggcacagttgtctacagattcctcatggatcaggaaagctggggtggggctggcacacacagtcaatggtcttgtaaataaatgtgttcggcccattccagccagtagatagtgtatcacaaggcaaggccatttacatatggtcccctgggcctaggtcaggcattgaatcaggcatgttacctgccagacagctatagtgaagatagattagcctcctgggtgtcaggtatatgcatagcacatgaacttcccccaagaaagcaagttggcctctccagaagaccccctgggactgtgtctttgtggcctaaattccagcagggagcagccacagacctcagacttgcttcttcagtttagaagatattcttcaaggatggcttctggtatcagaggtctcaagtaagtgtgtgtaaaatatttcagtgttggacctaataaatattattcttaaggaaataattcaaaaaacgaatacataggcaaagatgttacttatagtaaactaagtttataacattaggatggtgacatatctatttaatagactgtcatgcagctattaataattttgccccatatttaaaactttagaaaaaaaagacactagaaggagtgaaaatatcaaagttataatagatgagaatttcccagagatataaaggtcacaagtattcctattgaaagggtatattaagagtttagagtaaaaggaaaggaagagccaaacctagggatattactgtaaaatttcaaggattaagaataaagaggagatccaaaaaccttgcaaggtgcagaatagtcacctacaaaagagtaagaattaatcggacctcaaattttccattagcaatattgtatgcttagggctactttatctttcagacattgagacacagtgcctggggcctatgagttttttaagttctatggaaatattttatagaagagaaactttattctagatatatattatatataataactatatatatttctatagatatataatgtatatgattgtgatagaatatatatacacacatatatacacacacacacatatgtaatatatattgttaatataaatttggtctttgttcgcagtttctgacacagagttacaaaaacccttgtaattttacaatagtattaccaagctaggcctgttctacccatcatgcagtatgacaatcactgagataatgagttttgcagtaaagatttttttcgctaggtagccagcaagcagatgggaaaccagatctcaaattcacctccctgaatatagggcttaggcgtatttacaggataaagaagcaagctggtcatggagaaaggtgattggcagtgggaaaaaatgaggtaatcagtggtttgtgcaagaatagacagagtttgtggcttttcataggacacatgtgcattcagaaaatggtggcatcagcataatctgagggaggaggtttgggccctctaacatcaaaacgtgacctctcaggtatttgcacctgcccagttgaagcgttagtggtctccactggtttaaactggactcgttcttgaaaaataactttaagcaatcattaactatagtgatatatatgtcagagatgttatctacaagaaagctagtaggagtatagttatatattgtttgactgtgttacttttagccacataggttttaagatcaactggaagtaaccaattaaaaccacacaagtggtttggtagacttaaccaggttagcctttagtttcaatagagtcatcttttgttctaatatttagtctttgtacctcattcctggcacataactcctaaaactcagaatctctggagtggtaagagtgtctttagtgtgctattgacatgactggtggcctctagagagcttcgggatgggggctggtggccagaaaaactaaggcatgattagagggttgggattttcagttccactctccaacctctggggataggactggagatttagataatcatcaattttcaataatttaatcagtcatgtttatataatgaagacttcttaaaactccctaaatgacagggttcagagagcttcccagttgatgaacgaatccacatgcagggagggtggcacaccccaactccacagtatagaatcccctgggctcaggacacttccagatatgaccctatatcctttataataaaccagtaaatataagtacagtgtttccctgagttttgtgaaccatcctagccaattatagaacctgaggtgaagtatggaaatccctggtttatagccaattgttcagaagtacagatggcgatctgagacttgcaactggtgtctgatgtgtttctgtctcacgggactgaaaccttaacctgtggggtccatgtcacctctgagtagttagtgtcagtgtggatttgaacggtagaataaccagctggtgttcagagattaggagaattcatttttggtgtggaaaaactcacatatttgatgctaaagtactgtgagtaaaaagagccaaatatataatatacagagatgctatatccatattacatgtgtgtatatgtatatagattgagattcaaaactataatactatactataaaatcaagtatgagaaattattaaatatgtatgtagataatattatactatgatactttgtagtatgtttcatatgagaggtgggactccaaaacttacagtaccttggattaacaaaaattccgaaagtcttgctagcaatctaattctaggccctaaaacctaacaattacaagggaagtatccctcccctctagatttgcaaacccaaccaaactatcaaccaaggcataaggatattatgaaaacatttttaggtgagacagaactcagacattttaagttaattttaagtttctgttagcatttgaatgctgataactaattacatttttcatctttctccaaagttagtagccagttaagaaatatatacaaaaagctgaatgatcaatttaaaagtgatctatgtcgttgacagtactgaactggacctatggccatttgggtcccttactaaaccctcgatggatcttaaatctggagtttaggatcaatcacctgagggattttaagggcagtcagtcggtctttccagaatcatcgctttgcctggatgcagtatagaaagggcctcgagctagacattaaaggaagacttggttcctgacccaggtgtgcttgctatttgaaatagatccagaatgccaacagctagggcaggcctccttgaaacagaaatcccagaaggggctgagccacatgttctttctacattattcaccataaaagtaagacttttttcactgggaacaagggaataaacaagagacaagccagaagaatttcctccattcatgttttctctttttcgcctagggcagtggtgctccaagtgttgtccttaaaccagcagcatcaacatcacctgggaacttggcaacaacaacaacaaaaaggaaattctggggcactagctgagcaacttagcaaattagaaactctaggaaaggaactcagtgatctgcgtttccataagccctgcaggtaattgtaatgcactattatggtggagaaccactgtcatagagcagtaatggaagtttatttccttttttggaaatttgaggctaaagaagattcccccacccaatcaccccttgagattgtatgcctgataaatgaagtcataaactgaacatgacatgaggtctattcaagagtagctccaacccagaagaggagtgtctggaagtgaaaggatagctcatgtgcagtgtgcctaggaaacaacctgcctagaattgactagatggatggtgggctcaagaaaggaggatttgatagaagagtcagtgtaattgagaaaagctaatggatctgcaataaagcacgagtcaggcacggtggctcacgcctgtaatcccagcactttgggagactgaggtgagcagatcacctgggctcaggagttcgagaccagcctggtcaacatggtgaaacctcatctctactaaaaatacaaaaattagctgggcgtggtggtgtgagcctgtaatcccagctactcgggaggctgaggaaggagaatctcttgaacccagaaggcaggggttgcagtgagctaagatcgcaccactgcactccagcctgggccacagagtgcgactccatcttaataataataataataataataataatacaaccggctgggcacggtggctcacacctgtaatcccagcactttgggaggctgaggtgggcagattacaaggtcaggagatcgagaccatcctggctaacatggtgaaaccccgtctctactaaaaatacaaaaaattagcagggtgtggtcgtgggcacctgtagtcctagctactagggaggctgaggcaggagaatggcgtgaacccaggaggcagagcttgcagtgagctgagattcgtgccactgcactccagcctgggcgacagagtgaggcgctggctcaaataataataataataatacaataaagtaccaaggaaataagaaggaagagaggaatggagagaggaagaagaaaagaaagatggaagagaaggaaggagagagggagacatggtgacagaaaagaaagatgaagaaagaaataatagataatcagcaactcaagaaaaagaaaaatacttcataaaaaacgaaatgagtcaaaattaaatatgacatggatttgagcaactagggccatatcaacaaaaaaggaaactctgtttcctctgaagtaccaccagagtggtgacattggaaccttagggatcacagtagttgtctttgtggtatcatcataataatacataacactggttgttgtttcccaacttttagaatcaatacacaggcaatgaacaaaaaactaaactgtggctacaaaacataaaaaagatgtagtcaatccgaaaggtgtacaaagtaaggtacaaccaacaaaggtttggaggtaggaggtatgaggtatgaggagcaaacacaatgggaagaatgggaatcctcacttcctcatcattcgacatagtaaacaattgtcaatacctgtgcagcaagagatagttttaggtaagcttctcaattttctaagtcaccagttggagaaaggtgatgcatgtgggcataggtgactctattagatgaagcagagcaagaaagaggaagtagtatactgccacgatgcatgcaaacttaacattatcaaggttaataagctggatatcaaggcttttgcacagattgatatatgttgctgggtaaaaacttacattgctttccatgggatttatatacaacagtgaattaactataaaggctaattcatttcgttgtgatgttttgagatgtcagcaatatcactttgttaatttccacaaagtcttccatatcttgaagcccggaagatagtgccctgagcttatgcattctttaacccaaacaatccatattagggacacatatggccttccagaggcactctatggtctttccacttttaatttttttagaaaaacaagatatcactctgttgcccagactatagtgcagtggcatgattgtagctcactgcagcctcaaactcctagattcaagtgatcctcccaccttagcctcccatgtagctgaaactataggtgcacatccaattaatttgtttatttttattggagacggggtctcactacatttccctggctggtcttgaactcctggcctcaaacaatcctcctgactcagcctctcaaagtgctccccacttttaatgatgtcttttggtggctgaagaaaaaagaagggaactttcttgtcagctttcataatacagtaatattacaccaagatctagtcccacccaccaaaagtagtctttgaatttcctcatgctgaattgactttacagtcttcctttttctccctaggtcttgaaggctcatgttaatagaaagcagtcctaagatgtgtattcaggattcaatttggtatttgctaggtaagaaatctgggcaagtttccttttgttttgtaataattccttttgatataatttttaacttgaccagattcaccctctttacttttcatttttgtttttgtaaccttttaagaaagagaaagccataccctgctttaggtatttgtttgagtttctaatgagtttgtagagatgaaaatactattcctattttaaagtcctgtgccaattccgggatgaaagatggagtcacagaaagggtatcttaagggaaatagtataataaaggcagtgaaaactacaagcaagagtgatatcatctcatgggtaaggctttgttacccatggaaggtgaaggacagcaagtgctgtactatgtgtcagcaccttagcatcatgggaaatgatcactttccaccgaggaagcagaaatggtggagtgtaagtgtggggatgccaatggcatagacagtgcttttcctaacaataaagggagagttaagagcccaaaatacttcactttgcaaaaatcagagtgcatgtgtcctggaggactggaatagagggggagctggttgaaaaatagaaaggaaactattaaaaatcgttgaattataacttaaagcgagccgatgtgatggtatgcaaattatatctcaatatggctgttcaaaacagggcagatgttgtgggtcaggaaaaccttgtataaaaaggtcaaggaattacaaatcttgggcaaacacttattgcataaaaataattgtatcaatagcttttttatttcactctaagtacatgtgctatatattttcatttgaaaaaaattaaaacttgcacttggaaaattatgcttcttttccaagaagctcttagctagcaactgtttgtgaggactttatcaagggaatcatcacgttttcatcattgaaaataacagaggccactgcatctcaaattattcccacaaatgggaacgaaaggcacttctctcctttagcatatggctaagttggcttccatcttctccatcttccagctaaagtgttatgtggcaaatggatattttctctaaaggtatcccaaagaaacctttccagggtaggcagctgcctcccatgcagcagaagcttatggaatagtgtaaattagggcatctccatgtcactagacctacagagtctatggaaggttgctaacttacctagtgaattccaagcatggaacaaacagttggaaagaaagagtctaaaagttcaaagaattgctgcttctctgatggcaagcaggcatgtgggaggctgggtcttggggtaaagagtcagagccacatttaggggaattgctgaaaacagattccaggagaaggtgtggcatggaacatcagatggctatttcacaaggcttttcaacctctggatcacaactgttctcttttttctttaattaggaaggattgtgtcctcagactttcttcagatagccccaaaaggccccatcctaggagtagaccagccttcctggctagcagaaatattactcaaaaagaaatgtaagtcatgacttccaggaacattgaggctcctacctcatttaccttaacccctatcgagtatgtttgccaggcttaaaagtatatattattattcaagtaatgcactattatattattttgtaaaaattcaaatatgtggaattttcagagtcaaaagtcaaatgtctttgacatctttgtcattccctttacctactctcctcatagtccccttcctagattcaggaataactagtatcaatttagtgtgtatcctcccgtacctttttctacgtttttagatacataaatattatatgcagaaatacagagttgtgttctgtatcttaacacagtaacagacactatgcattcttatgcaatttgcttttaaatgttaagtgttgcaatgttaaaagcaattattggctctctttgccctgtggcatacttatccgtaaaatgggaatgttataatttattttaccacttccttaatcacgtagattttgtttttcccccattttccattactataaacagctctgtaatgaaattttctatacttgcctttgagcatttttttagggaataaaatgtagattctgggttagagggtaagcacattatgcaatttaatagatattgtcaaaatgccatcctaaaaaactgtatcaaattatactcccaccacagtcttaacctattctaggaaaaccattttagaagataggaaattttagactcctgggtctaagttcttggcttcagaagcattgggccataggagctcagatatccatggaaaccttcttccaaggaggcaatgtttccagacccaccacactttacggtggtctgcaaagaccatgccaaggattgtgatttctcactaggactccagtgagggagtcagatccccacacctttttatgtactctttctaggtgaattataaccaaaatcaaaatttggactaaaatcagcctcctgtctttgttctgaaagtgtaagaaataaaacctgattttggaaaggaaaaagtgggtaaaaagaaaaaaaaaaacactgagaacaaatttcagcccatgtataggacagataaaaaaggtcaagtgattcatcttttttccctctacctaaattgctgcagcttcaatgcaacagaagtgactctggttgcaggaaccatcttcggttgggattaactgttttaggaatgcaagttagtatactggaattagaatgagcttgtctgggttcaagtccttgctctacatttattaccatatcagcttgaagaagccatactgttcttcttttccagctcggaaccttggattgttctcttcttggcacggaattctcttcttgcaaattttcctgaggctgactttctgttaccattcgagacccaaatcaaagttcttttcttccaaaaggctgttgctagaactattggaaaagagaatttatatttcagtttgctttcttgggcctatttatgctgccttaaagaaaagacaagcctgagcacaaagccagtacaaaatactgggagagccatatttttagtaatatcttctgagcatccatatcttaaaaagccttttgtctggcctatgtattctcacttactcttgaaggtagaacacatgcacacacacaaaaacacacacacaatcacacacatgtacacacacgtaccaattctatgtagcacaatggttttcaattttggctgctcattgatatcccctaggaagctttataaattctgatgcctgtgcctcacccccattgatactaattgaatttgtttgaggtgtgttgtaggcaacagaattttctgaagcaccccaggtgatcctatgaggtatgccaaggtagacagcaattggttcattggttcacaaactcttgtttccagataagcagcactggcatcaccagtgaagttgctatatttgcaaactcacaggctccactccagacttctggaattgaatagtccacagccagtatattttaacaaaccttccatgtgatgctgatggatgcttaggtttaagatcctctaatctagagaggtgatttggcaattttagccactacatggctttttgccattgtgagaaatttgctgctattagatgagaggtagatgaaactgcttgagtcctggccatgctttggagctagggagaggtagaagaggtgatgatgggtttcctgctgccttgacaagattagggagagtgatttaaacatgtctacttcagtgcaaggccagttcaataaaaaataaagtctcttctctaagagcaaagttggtatcacaacaaaggtggcaatagggcagcagagattagaagaggagtcattggcagcattggagaacgctagaggagttgcaccctctggggtataagatgtagagggttcttatggttcctgcagagggtgactccagaagggaccagtcaagctagagagaagtctacacaaccctattgccctctgctgggaaaaacaaagatttggtgtggatgtgagtcagggcatccagaaacgaggttttggcatcacagtgtgactcaccatatcttctttgccatttcttccaacagtcagagattcatgtgccaggtaagacacagcacattaaaggagaagcagcaggtcagtagaacaagtttaacctgttatattagtctgttcccacattgcaataaagaaatacccaagactgggtaatttataaagaaaagaggtttaattggctcacagttcttcaggctatacaggaagcatagcagcttctggggaggcctcaagaaactttcaatcatggtggaaggtgaaggggaagcagacacactttacatggtcagagaatatggaagtaggtgcggggactaacagattttatgctcacttactcactatacagtaccaagaagggatggtgctaaacaattcatgataactctacccccatgaccaaatcaccttccaacaggccctatctccaatattggggattataatttgagatcatattttggtggggaacacatattcaaaccaaatcattctgcccctggcacctaccaaatctcatgttcgtctcacatggcaaaatcccaccatgcattaccaatagtcccccaaattcttaactcattccagaattaactctaaagaccacagtccaaagtctcatctgagacaaggctagtcccttctgcttatgtgcctgtgaaataaaaaacaagtaagttacttgcaggatacaaggaagtacaggcattgggcaaatactccccttccaaaagggagaaattggcaaaaagaaaggggctacaggcctcatgtaactcaaaaacccagcagggcagtcactaaatcttaaagtttcaaaatgatctcctttgactccgtgtcccacatctttgcatgtgcactctcatgcaaagggtgggctcccaatttcttgagcagcatcacccctgtggttctgaagggctcaggtccccccagctgcttttaagggctgaagttgagtgcttgtggccaagtgcagagtgcaagctgtcagttgatctatcattctggggtctggaggatggtgaccctcttctcacagctccactagacagtgtcccagtagagactctgtgggagggctccagtcccacatttcccctttgcactgtcctagtagaggttctccatgaggactcctcctttgtatcagtcttttgtctagacatccaggcttttttatacatcctctgaaatctaagtagaggttcccaagcctcaactcttacactctgcatgccagcaggcttaacactacatggaaactgccaagggttatggattgcaacctctgaagtagtggcctgagctgtacctgggaccctttgaaccacagctggagctggaggagcaggggaacagtgtcctgaggctgtgcagggtgacaggtccttgggcctgatccacaaaaccattctcccctcctagggctccaggcctgtaatggaaggactactaagaaggtctctgaaatgcctttgaggcctttgcccattgtcttggctaccagcatttgccttctttttagttatgcaaatttctgcagcttgcttgaattcctcccctgaaaatgagcttttcttttctaccatattgcctggctgcaaattttgcaaacttttatcctcttcttcccttttaaatataagttccattttctggttatttatttgttcatgcatgtgagcataggcttttagaagcagccaggtcatatcttgaatgctttgctacttagaaatttcttctgcatgataccccaaaacatcactcttaagctcaagcttccacagatccctagagcaggggaactatgcagccaacttcttcactaacacaaacaaatgtgacctttgactatagtccagcactttgggaggctgagtgagcagatagcttgagctcaggagttagagactagcctgggccatatggtaaaactccatctctacaaaaaatacaaaaattagctgagcatgatggtgcatgcctgtagtcccagctacttggtaggctgaggtgggagaatcactgaatctgggaggtcaaggatgcagtgagctgagattgcaccacttcactctagcctgagtaacaaagagagacattgtcaaaaagaaagaaaggaagaaagaaagaaagagagagagcgagagaaagaaagaaagaaaaaagaaagagacatttgctctagtttccaataagtttctcatttccatgtgagacttcctaggctgagggcctagactttactatccatatcactatcagcattttggtcacaatcattcaacaagtctctaggaagttctaaactatccctaatcttcttgtcttcttctgagccctccaaaatgttccaatctctgctcattacacagtttcaaagttgcttccacattttcaggtatccttatagccatgccccactcctcagtaccaatgttctgtattagtccattctcacactgctataaggaaatacctgaaacttggtaacttataaagaagagaggtttatttggctcaagttccacaggctataatgaaagcatgattctggggaggccttaggaaagttataatcatggcagaaggtgaagagggggtcagcacttcacatggtcagtgtcaggcctctgagcccaagccaagccattgcatcccctgtgacttgcacgtatacgaccagatggcctgaagtaactcaagaatcacaaaagaagtgaaaaggccctgccctgccttaactgatgacattccaccattgtgatttgttcctaccccacattaactgagtgattaaccctgtgaatttccttctcctggctcagaagctcccccactgagcaccttgtgactcctgcccctgcccaccagagaacaatcccctttgactgtaattttccattaccttcccaaatcctataaaacggccccacccctatctcccttcgctgactctcttttcggactcagcccacctgcacccaggtgaaataaacagccatgttgctcacacaaagcctgtttggtggtctcttcacacggacacgcatgaaatttggtgccgtgactcagatcgggggacctcccttgggagatcaatcccctgtactcctgttctttgctccatgagaaagatccacctatcacctcaagtcctcagaccaaccagcacaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaaggagacacgttttatccatggacccaaaactctggcgccagtcacggactgggaaggcagccttcccttggtgtttaatcattgcagggacgcctctctgattatacatccatgtttcaagggtgtcagaccacacagggatgcctgcctttgtccttcacccttagcggcaagtcccgcttttctggggaaggggcaagtacctcaaccccttctctccttgtctctaccccttctctgcttttctgggagaggggcaagtacccctcaaccccttctccttcacccttagcggcaagtcccgcttttctagggggcaagaacccccaatcccttatttccacaccccaacctcttatctctgtgccccaattccttatttccatgccccaaccctttctctgcttttctggagggcaagaaacctctaccccttctccgtgtctctactcttttctctgggcttgcctccttcgctatgggcaagcttccaccttccattcttccttcttctcccttaggctatatgctttttttttttttttttttttttttttgagacagagtctcactccttcgcccaggctggagtgcagtggcgtgatctcggctcactgcaagctccgcctcccaggttcatgccattctcctgcctcagcctcccgagtagctgggactacaggccccccccaccacgcccggctaattttttgtatttttagtagaaacggggtttcaccttcttaggcaggatggtcttgatttcatgacctggtgatccacccgcctcggcttcccaaagtgctgggattacaggcgtgagccaccatgcccggcctagcctatattcttaagaacttaaaacttcttcaactctcacctgacctaaaatctaagcatcttattttcttctgcaatgccgcttgaccccaatacaaactcgacagtagttccaaatagccagaaaatggcactttgaatttttccatcctgcaagatctaaataattcttgtagtaaaatgggcaaatggtgaggtgcctgacatccaggcattcttttacacatcagtcccttcctagtctctgtgcccagtgcaactcgtcccaaatcttccttctttccctccctcctgtcccctcagtcccaaccccaagcgtcgctgagtctttctaatcttcctttactacagacccatctgacctctcccctccttgccaggccaagctaggtcccaattcttcctcggcctccgctcctccaccctgtaatctttttatcacctcccctcctcacacctggtccagcttacagtttcgttgtgtgactagccctcccccacctgcccagcaatttactcttaaaaaggtggctggagccaaaggcatagtcaaggttaatgctgctttttctttatcccaaatcagaagcgtttaggctctttttcatcaaatataaaaacccagcccagttcatggctcgttcggcagcaaccctgagacgctttacagccctagaccctaaaaggtcaaaaggccatcttattctcaatatacattttattacccaatctgctcccgacattaaataaaactccaaaaattagaatctggccctcaaaccccacaagaggacttaattaacctcaccttcaaggtgtacaataataataaaaaaaaaaaagttgcaattccttgcctcctctgtgagacaaaccccagccacatctccagcacacaagaacttccaaacgcctgaaccgcaggagccaggcattcctccagaacctcctcccccaggagcttgctacacatgccggaaatctggccactgggccaaggaatgcccgcagcccgggattcctcctaagccgtgtcccatctgtgtgggaccccactgaaaattggactgttcaactcacctggcagccactcccagagcccctggaactctggcccaaggctctctgactgactccttcttggcttagcagctgaagactgatgctgcctgattgcctcggaagccccgtagaccatcacggacgccgagcttcaggtaactctcacagtggaaggtaagcctgtccccttcttaatcaatatggaggctacccactccacattaccttcttttcaagggcctgtttcccttgcctccataactgttgtgggtattgatagccaggcttctaaacctcttaaaactccccaactctggtgccaatttagacaatactcttttaagcactcctttttagttatccccacctgcccagttcccttattaggctgagacactttaactaaattatctgcttccctgactattcctggactacagctatatcttgttgccacccttcttcccaatccaaagcctcctttgcatcctcctcttgtatcccccaccttaacccacaagtataagatacctctactccctccttggcgacccttaccatctcattaaaacctaatcacctttaccccactcaacaccaatatcccatcccacagtgcgctttaaaaggattaaagcctgttatcactcgcctgctactacatggccttttaaagcttataaactctccttacaattcccccattttactgcccaaaaaccagacaagccttacaagttagtttgggatctgcgccttagcaaccaaattgttttgcctatccaccctgtggtgcccaacctgtacactcttttgtcctcaataccttcctccacaactcactattccgtgcttgatcttaaagatgcttttttcactactcccctgcaccccttgtcccagcctctttttgctttcacttagactgaccctgacacccattaggctcagcaaattacctaggccgtactgccgcaaggcttcatagacagcccccattacttcagtcaagcccaaatttcatcctcatctgttacctatcttgcataattctcataaaaacatacatgctttccctgctgatcatgtccgattaatctcccaaacctcaatcccttacaaaacaacaactcctttccttcctaggcatagttagcgctgtcagaattcttacacaacagccaggaccgcaccctgtagcctttctgtgcaaacaacttgaccttactgttttagcctggccctcatgtctgcgtgcagcggctgccgctgctttaatacttttagaggccctcaaaattacaaactatgctcaactcactctctacagttctcataacttccaaaatctattttcttcctcatatactttctgacgcatatattttctgctccccggctccttcagctgtactcactctttaagtcccacaattaccattgttcctggcctggacttcaatctggcctcccacattattcctgataccacacctgacccccatgactgtatctctctgatccacctgatattcaccccatttccccacatttccttcttccctgtttctcaccctgatcacacttgatttattgatggcagttccaccaggcctaatcaccatacaccagcaaaggcaggatatgctatagtacaagccactagccttcctcttagaaactttcatttcctttccatcatagaaatctatcctcaaggaaataacttctcagtgttccatctgctattctatctgctattctactactcctcaaggattattcaggccccctcccttccctacacatcaagctcgaggatttgccccagcccaggactgacaaattagctttactcaacatgccctgagtcacaaaaactaaaatacctcttagtctaagtagacactttcactagataggtagaggcctttcctacagggtctgagaaggccactgcagtcatttcttcccttctgtcagacataattcctcagtttagccttcccacctctatacagtctgataacagaccggcctttattagtcaaatcagccaagcattttttcaggctcttagtattcagtgacagacaaatggtctattagaaacacacctcaccaagctcagccaccaacttaaaaaggactggacaatacttttaccacttttgcttctcagaatttaggcctgtcctcagaatactataaggtacagcccatttgagctcctttttattaggccccagtctcattccagacaccagaccaacttggactgtgcccccaaaaaacttgtcatccctactatcttctgtctagtcatactcccattcaccgttctcaactactcatacatgccctgctcttgtttacactgccagtttacactgtttctccaagccatcacagccatctcctggtgctatccccaaactgccactcttaactcttgaagtaaataaataatctttgctggcaggactatgctgaatctccttaggcgctctctaatcagatgtcctaggtcctcccaattcttataccttttatacctgtttttctccttctcttattccatttagtttttcaattcatacaaaaccgtatccaggccatcaccaatcattctatacgacaaatgtttcttctaacatccccacaacatcaccccttaccacaagatcttccttcagcttaatctctcccactctaggttcccacaccacccctaatcccgcttgaagcagcccggagaaacatcgcccattctctctccataccacccccaaaaattttcgccgccccaacacttcaacactatttttatttttcttattaatataagaagggaggaatgtcaggcctctgagcccaagccaagccattgcatcccctgtgacttgcacgtatacgaccagatggcctgaagtaactcaagaatcacaaaagaagtgaaaaggccctgccctgccttaactgatgacattccaccattttgatttgttcccgccccaccttaactgagtgattaaccctgtgaatttccttctcctggctcagaagctcccccactgagcaccttgtgacccccgcccctgcctaccagagaacaactccctttgactgtaattttccattaccttcccaaatcctataaaacggccccacccctatctcccttcgctgactctcttttcggactcagcccacctgcacccaggtgaaataaacagccatgttgctcacacaaagcctgtttggtggtctcttcacacggacgcgcatgaaaatcagagcaggaggcagggatggggaggagctacacacatttaaacaaccagatctcaccacaactcacccactattatgagaacagaacgaagggaaaatttacccattgattcaatcaccacccaccaggcccaacctccaacactgaaaattacaatttgacatgagatttgggtggggacacagacccaaaccatatcacctgcagtgtcgagctgacctgaatttgaattccagttccaccactacctaactgtgaatatggccattttacagattatttcatctgtaaatggagggtaaaccatgttggtttgtgtaagaattaggaattgtgcttagcacagggcatagcagccattaggcggttctatattataattattactaatatttagccagttaattaacaaatattaggtgtttactccttgccagagtctggtgaaggccctaagaataaaataataaagaagaacagacacagctattttccttggaagctagtaggcatacagacagatattcatcaaataattattactcagataatcacacaaataatacacagtatatctataatatgtgatataaaatgtagagaccacaaaggtatgaatgtggatgacggggagtgtgttctaaactgggaggagggaggcaagtgtcacagatttcctgagaaggtgccatttaaactaatgcccaaaggataaatagacattgcataggcacggggaaagcaaatcaaaaagttttccaaataatggcaacagtttgtgcaaaagtcctatggcaaatggcaacatcaaggaacttaaaattatcagtgggtactgggctcagaaatcaaaagggagtagagcttcagatttggagaggaagaaaagtgacagaaatacaaaagtcatgcttttctctgttgttgtttttggtagcagtggtagtagtgtagtattccattccaaatttctgttcccactttaaggtattttatcatgattagtgtccagccacatataccatgaagacacactgagggccactaggctgccctggtcacaacctaagatcgtcctgtccatggctctgtgggaggctccgtttggatgtagagcaaaggagtggccccaatgtgagtggggtgtatagccatgaggacatacgcttttctcatttcgactctcttgtggttttgaatagcgtacttggtggttgaattaacaaagcactttgctactctctggctatggccatgttctggaaaactctcgatcaggtagcaaaatgaattcaacccttactgttttccatacaaagttctgaaggctttatgtattttgccactgattctcccagcattcacagtgactggttcaggctggcctgtgtttttcctagatcatctttattgccagtgtccgcagttgctggaagactttccaggatcctgcatgcatatggcttttgatggaaaaatgtctcccttggcatctccttgtaggagtcacatatatcaaaacccagctcccagaccacccttccagccaaacattcataaacgtccaggagggaaagaagttatgcaggaagactatatctcttaataaaatcttgagagagtttccatttcatttctaataaatcttctgtaagtgagtgttgtacaatactttcttaagaggcaaaattgcctccaaatcttttcctggatcaggactacagaatcatttgtacccgtctaacacatcataatctatctttggcttgacagtagtagacactattttttatttcatatagtatattattattcaagctcttttttaataagtaggttttcactgaatacaccttcttcttaataaaaaagtctaataaaatttagcataaatgtcattatttccccttttattaaaacttgttttaggagctctgctctatatttttgggctctaaaaaggggcagaaatttgagagagttggtatagcactgtgggttagaatgcaaactcaggattaaatagacctgggttccagtccaaacctttctgtgtaacctagagtgagtaactttacctctctgaacatgcttttgtttcctcatctatagaaaaggaataattagagacaattttaaggatttcaaaggaaactgaacctaaaagtttaatgcagtgcctgacacatcatctacactcattaaatttcattttattatttctttatcccatctaatctaataatagcctcaggtccttttatctaattatagtaatagctgccattttttgatcacatactatatgctgtgaattgccaagtgctttatgtgaattatctcattaaatattttcaataactctgtaaaataggtgttattatcattaccattttacagatgaggagattgagaggcaggcacattaagtcccttatgcaggattacatggctgtgagcagtagaattgtagtatcctctaatgcctgctctgagttgtggaaaatcagggctccagactacccaaaattcctttgttaaggatggagccgataggatctctttatgatgctctgtggtccttctcaaggacatgcagcacacctcagactttggaaggagggcttagccactagactggggctgtcctgggagggtcattttatgatccagtgaaatagtggaacgtgcctggaattctgactgcgtcagatctgcactcaaataggctgaagaggtgaatgaccttgttcaattattttaaatgttctgacagccagtttccttatttgtaaaatggagaaaggaatgctaactagctcacagagaccttctggggaagctgtactgcatcgtagtggttaggcacacaggttctagaatctgactgcctgaggtttatccacttcactatgtaactgaccatgagaaagttatttgatcttttagcctcagttccttcagctttattgtgactcttaccagcagtagagaactggtggcattgttataataacatcaacagaataaatatgactgaaatgagggtcaagaacatattttcactatttttcctatgtgaggaattcttcattatgccccagttgtatgttaccatttttaaggaatttgatataagtggagaaagtctatcattagttacactggtcctaaacaacaattattaagtgatccaaggctgccagcatcacacttggcaacatcagttacaatataggagtgccagggggcatagatgtacttgagctggcttttgatctcatgagtttctacacagccccccaagtgaaatgatttagaatcaaccggtaatactttcagagaaacaaaagccttgagtttattctctactcaatcagaagtctgcaaactctttctgtaaagaatctgatatgagttaggttcccattttagaaatgcttggtattggaagtgttttagatttcagattttttttcagattttggaacgtttgcattatccttactcattcagcatccctaatccaaaattctccaatgagcgtttcatttgagtgtcatgttggtgctcaagaagtttgatttcagagcattttggattttggattttcaaattagggatactcaacctgtagtcctatatttcaggcttcatggaataagagttaatgtcttcaactctttcaacaactgttctcactgaaggacaaacggtctttcttacattttacattagaaatgtaaaaagcattcttagctaatatagcctaacggaaacaggaagcaggctggatttggtccggcggttatggtttgtcagctcctgtcccagagtatggtggttaagagcgtggattctggagctgcaccatgtgagtctgtattcttgatttgtcactttgtagctggatgacctaggggaagttgtttaaactttccatcttcatttcctcatgtaaagcatgtaaagatgtcatgggagtgctgggggttaaatgagtaaacacatgtcaagcattcaaaatggagttttccatgcaataagtgctaagtgtttgtctttattattattatgttccaatttttcctgtttctcccagttttggaaaatacctgtagcatcagcccttttttacatcatagtgttctatttctctatagtccttccaacagattttctctataagtgctttcatgagtctcttgcatccaaatcatctagcgaacttgttaaaatgcaaattcctggactcctcccaagatttgctgtatcctgacttctagaggtgggccctgagaatgagcatttaatatactttactggtggttgctctgcacatgaattttagggtccactgcccctagagttccacatatcctccttcttataaagattcccggctggaagatagatgaaaaggaggggtacgaatcactgagttaaccctaagtctgatctaccagcaaccctgcctgagtgtcaaagcccagcagttaaaatacatgcttctaaatttcctccagtaccaggaggggaaggaagaagtactgattattgggaaaccaagcaccacccctatccagactgtgtggttggacacaggggagctaaatgaactcagttaaaccttgtggatttggaaatgagcacggaaagactgatcttatagtggcccaggcccccttccagagcagtagggcttgtgatacacaagaacacctctggacttcctctgaacttcactatgaaaagcgagaaccacagtatgcagctgctgggtacaaaactttcagggttttgcatttcctaagtgcaactattgtcatttgcttttcgatttatgcaatacttaatatttggggacatgttttttaaggtaaaaacttcaatgagtaccaattttgaaaggtaaaattttaaagtacttttctatcctcagtccctctcaccaaaagtaaccataattattattttcttctctgtccttctggaaatgtctcaagcatatgcaaaaaaacttatgggatgtagttgctagaaatacatattttttgcactaatatgatcatacaatatttattctaaggcgactagttcctttgacttaaactgtgtcctggaccaaatgatcacttttgattccaagtacctacttctatcacatttatcctttccgaatgcccacctccttcttccttccattctgtaatgtcattctttatgttacctagaaatttataatggatgttttattatcatcatcaaaataaggatgaacgcctgtagatagaagtattattcttaacagaccacagatgcatagacaaagctctccccccacttataaatgagtctgatgtttccttgggatctgtcagggaaacattattttccccttggtctagggacagcttctagcatagctgatgtagctaccaaacaaagaagggacactgtggcttcctaaagatatccatccccgggcaccatgctacctggggatctcctagctcacaattggaagttcctattgaagtttgaaaagctgttaggcaggatagccaagcattggtttgctcacaaaatctactctggcctagatgccactgttcatgttgggagtatcaggggaaacatctccagtgggcagtagtaggacttacagagtgctgaaaacaggtaagtggtgtctaggtgtgtaaggaaagagaagaggtagactgtttaccatagtccagtagcctgccacagtttgtcaaaagaatttgagaggctgagcgtggtggcttatgcctgtaatcccagcactttgggaggccgaggtgggcagatcacctgaggtcaggaattcgagaccagcctggccaacatggcaaagccttatctctactaaaagtacaaaaattagccaggtgtggtggcatgcgcctgtaatcccagctactcaggagactgaggcaggagaatcgcttgaaccagggagggggaggttgcagtgagctgagattgtgccactggactccagcctgggcgacaagagtgagactccacctcaaaaaaaaaaaaaaaattgacagtaggcaagtgaaatgaagcctcatgaacacttaataaaaagggaaccagcatgaggtcatcgagatgacgccatccctcagtaccctcaataaccacatttcctttcttggtgcagttgccagactagaaaaccaggatagtaccataaacatagaggatcagaaattcagaaacaggttttacaaaagtctcttacgagtgcaggatggtattttatttggttgagctcactcttagaggatgccagcaaatatgtgaatgtctgactggccatggatcactggcagtgcacctaaagattcactttgatacttgcagaaccttatagatggcataccttcagggacaggatggctgagaattctagttctggagaaatgcaaaagtcccaagtagcctgggacaatgggctactcattacgagacctgtgcattggagctgatatggacgagcaaaaacaagcaaggttcattatcaattaggggaagacatgaaaggtggtgagagacctaggaaaaaagaaagaagtgattccttttgtgctgggcaggtagtgtggcagagaccatttccatcagagtctttgatctcctagggatatcagtttgtgatgagcttcatggggaagaaaggaaaaactctaatactgtagaagtaacccttcagtgttttttaggaatagagtctgcccaagagcaaggagcaaataatgagagtcctcatgaattttcaaagtcctttttaaagagtagttcagacaacaggaccctgaaggccaagtgagaccttggtagcctctggactcttgacgtttttcctctcttgaaataatcatccctgagtgaataagaatcggtgacagaggcattcattcaacccaccgttgccaaatatctgtctaccctgcacctagcctgtaactagtgctgggcaaatagaaatgcgtaagaaacaccgctcctcaggccgggcacggtatctcatgcctgtaatcccggcactttggcaggccgaggcgggcaggtcacaaggtcaaaagatcgagaccattctggttaacatggtgaaacagcatctctactaaaaatacaaaaaattagctgggcatggtggcacgtgcctgtagtcccagctactcgggaggctgaagcaagagaatcacttgaacctggaggcagatgttgcagtgagttgagatcgcgccaccgctctccagcctgggcaacagagtgagactgcgtctcaaaaaaaaaaaaaaaaaaaaaaaaaagtaaaaagaaaaaagaaacgccgcttctctttaaggatctcacagccaagacaatgtttcccaagcaatggtgcccagattacctaatcagaatcacctagatgctgtgtcaaaaatgaagatttctggaacacagcctgtatttgctaaatctacatgttaacgattccctcagttatggatgtgaacagaaaactgctctgaaggaggcagataggaatctatctctgagtatgagagtgagtacatgtatggggtgatgggtgaaggcatgcgtgtatatattgtaaggtggtgaggacatgctaagagtatacgcatgagcatgtatgaatgcctgtgctgagggaaagtgcatgctgcattaagaagctatacaaagtgttcagttacttaatcagaagagaacaaaggcccatagaccaagtttctgaaactttaaaaggctcataccccatccagagtaagcttaaggatcagaggtgagaaactaccatcctcatagtttagtctgcagtccatgggatacagaaaaagcaaacatttttgagactgtctatgtctaatagcaacagcagtttttgaagtcacacagatctggacttgcatccggactgtgtcacttaccacttgtgtgatcttgatcaagaagctcatacactgaaccctaatgcccctgtctgaagaataggggtggcagtgccaatccttcagggtattgtgatcctaacattgctatgtgtgatgcagccccaacaaccagacacataagatgtgggggagtggaaagtggtgtggctggaggtgtgaaatccaggaggtgagaggattaccctctaataaatacaactcttggggtcctgggaacaacctcatgaatttacagtgaagacagatacatctttcctctttcctctgatttttccttgatccttacaagaggtgctgaacttcctgttagcagacatgatcaagcagaaactgaaccatggagatgtgtcccccatccactagcaggactttgactttgggtgcctgtcttctctagcaccagaatcctgggattctgagtccctgggtttctccagcttcccagtgtcttatgtataggctgagtcgtgattacatgtttggctcccacggagagatcttgctcccacccgcttgcaccactaagactagctttttggagtcgatcagaggttgccaggagaaggtcatacattcaagaatagcgtttcacccagcttccctccccagtgaatgtgccacaccaggttggaagagacatggtctcactgcaggatctttcccaaatgcaccccagaacacgatggggcagcactcagctcaagttaccatgttccaacgacttcctacctaccaggctgccatatgttcaggatggttctattgccagatgtatgtcaaagttttcctttttaaaatgtaatttccaccagaatacactggcatcctacaatgctgcttcttggctgcagaagcagtttttctgccatttgggcctaaaatagaaaccacacgcaaccttgacagtaatcacgaccaaggagagagaacgcacatctatttatgtggcactgaaggtgagttcttcctttgtgctactgcactggggaccagatcaacagagctaggaatatcagctcaaactgatacaatcacaaatatacaagatataataaactactggatattacaggtaaagtttatttttgagttttaaagaatttgagatattcataaattagggttttgtgtaggggtgacatagtgtattcattctcttattctttattcctcactgttcatgtctagtggacggtgaggtctcggcatctcatgacttgatggatatgacagtatccaggcatgtgttcatgtgaatgaatgtgctgtgtaaatagtggaagaactctcaagaattttattcagcaaaatcatatttattccaaaatatgtttttggcatccagaaaccacttctgagaatggaaatcacattcatgttttaaaattgtactcactttcggctgggtgcactggctcacacctgtaatcccagcacttgggaggccgacgcgggtggatcacttgaggtcaggagtttgactcccggccaatatggtgaaatctgggccaacatggtgaaaccctgtctctactaaaaatacccaaattagccagacatggtggtgtgtgtctgtaatcccagctatttgggaggctgagatgggacaactgcttgaacccaggaggcagaggtggcagtgagccaagatcacaccactgcaccccagtctgggcaaccgagcgagactctgtcaaaaaaaaaaaaaatactcactttcatttgaagtgaataatcagcatttttgttttccttttcaaatcccagtagttaggatggtagccttgatggacttaataggtaacagtcaacacatccctgagaacaaggtgtccatctgttccagaatacaaatatccaccttcacctcactgcttctcaaacctggtctcttcaaggtggtcctttctttcttttctgctaccagggcaaggctgttgcatttcagggttgtttctttattacctggcttatttgttcaaatggggttggatggaaaaacatgctgcttgcttaaatctgcaagaaaaaaatactacagggctctctggggtagccactggaaaattcaccactctgagacttttattgatgacaaactcgagtatgtttaagaaagcacacacacctagcaacgatttggacatgaagataatgtcagccccatgcacgggtacactgtccctgccgagaatttcactggagactcatttgggggctctagggcagggtctggctgccagctggtgttgagatggagttttccccccagagtaatcaattatcatttcccaagacgagctcatggaatgctgccagcacagtgggttgaatagtctgggagctggaattctttcccagatgtaggggtcatcccatgtatgtgtggtaacgatgaaccagaaaggcacagagaaaacatagtgactattgaaagtaggtctcaagttaaaaaaaatgttataaaacaggtgacagcaatactacacataaatatttgtcagctgggtgatgcagaagtaatcagacagatttctagggaccagtagaagaaatggatcttaagtataatctgttctaattccacaattaatagacaacagctttgatggagaaacttttctgtgcaaaacaatatccaacagcagacagatatagcagtagtaatccaaactctttcctcacggagcttgaaggacttgatgaacattctaaggaaatacagcatattaacatataataataaaatgaggcaagatatgagtgcttacaatgggtcaggtacactgttagactttagacacacaatttcccttaagtatttcaaaaaagtacaaggtatacactattttaattcccactctatagataaataaaccaagtttcagagcagtgctggaactagatgaaacaagtaagacacttgacttgggtgcaaaattaaaggagacaccaaaacctcagtaatcaagatttttaaatatcagaatgaaaaagtattacaataaaatatcaaaattttaaatgaagacacaatcagtattgctgattttttttttccttttgtctcaggctccagtctagcttggtgaggtgctggttcagagcattgatgagaagacttcccaaagctcatccatcagtgtgtggtacactaatgcctaagagatttgattttatggcttgaactttcaatctgtgcactccaaccgaggaggacaagggtcaagccttgctgatgcaggttctgggaaggaggtgtcaggggaagcctctcttacccagatttgcaagtggattgaaaaaagagcagatgtgcaaagtcaggagaatagtggtggtgggccaagtcccataccctggtgagaaggatccagctgggcttgggagaagctgattgtgaaatactgacagcgaaaggctatcgtggggagcaagagaacagcagctgagtaggccagtgggagtcaggactggatacattcctgacttagaaaagggctttgataaactccaagaaaaatgatgtgcagatgagcacgccactctacaaaatggcccaaagatggagtagagaggcatctcaagccacagagccttggctcaaaatcactccagattggcagtctgtaaaaccaggatttggaacttaagaacacaccatactttcctgtctccagggaaaggatgattgccttatgcacttacataattctgctcacaccccttcccccacaaatatttggcccctggaatgggacagggcgagttgatagctccctggggacagggtggactctggcttatagacacagaaagatttatttctgctgaacctgtgacagcttggtaagagtatttcaataatttgagctgcttacctactgttccttttgtttttaacaggttcagtcattcactttgctcaatggattgggcttgtctttagaaaggggaatgttgtagctcagaagccagtgatgggctcagtaaggggcagcaggtagggagtgagggtaaaagatagaattccgatagaggaaatatggaatttcacttacaaactaatggaatgcaaacgttgttggaattccataccagagagcaccccagtgaatccttcccaaatgtcctgaccttacgcctgttgtggtaatagtcaggttaatgtaagagatgtttccccagatacccaggtaatctagaaaacatattctaatttcaagggggattcacctcacaggcctggagatatgagcctctagttttcttcttttcgcactagtctattgacctccacaaaataagtaactccaatgagaattattccctttcgtattatcagacttcagagccctcaatcccatatgaagcactggaggcctgtctctttccagctccacctcccacatgcaaaagcttaggcaaggggccagctaacctgcttggctattggcaccttgaaatggaagtaaatccctactcttctgatttattatttcctgttcttcgaagaggggggaaggcagcaagtcttgaagtatttaagcagttagtcactgtacaaatccatctcctgtctcacccccaattcaggggaataatatttttttccctgagttacataaggcatgatagaaagcatttcggaaccccgtctgcctcaggaccgatttcttgaggtaaatctctaggaaatctttcacagtttctaaaataagtgcccaggctttgaaaataggtcctacagcatgagcaagctctatgtcacccatgtgttaaccttagcatcacttcctctctttctatcatcactgtcttcagttccaatgcagtttcatccagatgacaggtgcagccgtgtgcatttttacaaatggagctatgtttcaatcctggagatttttgatattaagttccgtaagtcaaaactcaaaacaacatgggaaaaaagttaaatttaatgtaaactggacaattttacgattagctaaagtactgagctcattacaaactggaaattccctaacagacattgtcttcgctggacaaggtagctaataatgacattaatttcttggggttttgtctgtatttgtgtttgtgtgtgagtgtattttatcactaaatggctaagagttgcacatctgtaacttagtcctgcctatggttgtataatggagggagattttttttgtaagactaaggtgttatttcttcttgctataaatggctgatagatcttggcttttctcagatgttctaggtcaggaaccatagtccatcagcctgcaatagaagagacacctgaaactagacttgaatatcctcctctcggctccttcccttctctcaaaccatttggtactcacatctgactttaagtaaatgtatttcccattagctcatctcagcttagctttggtctctgaatctcaggacccaaagctatgatttccagctagtggctcatagctttaacttattttctaccctcaaccacttaatatgacctatttaaattgccatcttcgctgtctgcatgtggccttttcttagatctgcttcttgcttctgggaacaccaattcctatcacaaaagattcattcacccccaatctatgaccactcagttgataagtacccacatgtattaaataacatgagaaagtcttagagtggaccctactatatacatgcacacacacacacagactgatacttcatcatgaatggaacacatctggccagagattgactgagacatatttgcctttgtaaatctggacatgcagttcccaggtttgtgaatcaacatattttaatatccttctaataatactgatctaataagtatcctaacactcaattctaggcatgtggtctgggaccaatcaaattccaaaattattgagctcctattattttcatttgaacttcattcaagttcaagtcatctagaacctctctgtcttctgccctgaccttgaaataagtctcccaagagatggtggtcacctactacctggcctttaaccatgatagacggacagcttgggattccagatacttctgattattcatctgctagtggccttggctgcattgctggatggcccagacgctgtgtattaatttgactttctactgctattcttggaatttttatcagtgtggccctagccctgttgagaacctcattatcaagaagtggcttctcctgggcagctgaagggatatttattaatacatgttttgagccctgtaaggaagggagaaaaacaaagaagactatattggctattattttctaaccctcccttcctcctcttcctttcttatttcctttcccaattctctccttttattcaataaacatagcatgttaactacataatttgtaggaacttgcaaatatgattagaaagaattccacctccacataacttttgtttgctacacacacccaaatgaacacacacacacccacacacacacttagaatgagaaaagttgttaaaggatatataacattaaacatcaaaacgaatgatacaaacagaaaaagtggtgctaatagttgaaagaaagaaaagcaaaatagcatctaaatcgattaagagaaaaagttaacaaacctgcacattgtgcacattgtactctagaacttaaagtataataataaaaaatatatatataaaagttaataatataagtaatcatatccattagttattgagcatttctatatcttcataaggcaaagtgtctgtctagagcaatcactgcttaggtactttcagcttactaaatgatggctccctccatacccaatgatgtgtgtgcgtgtgtgtgtgtgtgtgtgtgtgtgtgtttgtatgcatgcacaaatgcctgttgggatttcctttaggatctctctaaaactcacatctctatgagataggaataattcttaatttaccaatgagaaaaccaaagcttacagaggttaaatgacttatataactagtcagtggcagaactgaatctgtctactctgaggctaatgtttcttaacacaagatttccacaagaaggtgaggtttaagtatgacctaaaaggatgtgcatgactttatagcagaagttagtggcagggtagaaggcagaaaaaccataggttggaatgtgaaattgagacaaagcatgtacagcagggtcaatgagaagccagagagaggggaaagaaggtaaaaggaaacaatgatcagtgagacatagagagtaagccagaagccatatgtggaaattcatgaatactggaaagaagactgtgagcttgaatcacaggcaataagagtcccagacagtgtatggtggacaagtaatcgaatggcctcagttttaagaaaattaattcacccagaaaatccagatgcattgtgatggagacagcacacacacacacatgaaaaatttagcaattgaagaataacatttattccaatgtgatccaatctccaccactccaaacatttagaaacaaagcacatgaccttaataacctgccgtgaaaaatcctgcctcacatgcatttgtaggaaaacctctttttctttcttcagtcatttgtcatcaaatcagtttcttacctccaattttaattactaatatatgtaatgccactcaaaagaaaaagagagacagacagatttatcaaagcaaaacagcagctcccttctgatctcacatcatttctaaggaatcaggagtcaatatggggtaagggaccctgtactaacagagtaaaacatgttcaaaacttcaccaacaacctctgagagaagatggagtttggtcaggagctgctaatggttgagatggcttagcatgtattacttgatggagagagtactggagagctttcaattaagctgctgcaaagctccctttctgctcaggctctttgacaggtcattgaatggggttttcaaggacaaagaatgagcgggcatgtccccatggaagccagtgcccctctcagaagtgttaattccagtgatttctcctggaaaaggaaatggagaagtcagggatggataagcctgctgactaatctataaaaccaatgccccaggactggcagaagttgaaatcatttacttataattagaggtgcaacagactgtgggacttgaaattttacgattcaacattcttggtgaaaatgctcaataataattaagaaaacaatcaaaatcttgggcaagaaatatgtgaattaatatcagatatcctcttctcaagcaagaccagcataggtcttctgataagtcaccactttgaaaactgaagttaaacataatcaaaatcttcccttcagcaccccaccatcactagggctgggattatgtaggacaaggggattttaggctatgaggggacatagaaaagaaggtcagatttctcaagacttcctgtcagggttgacctttaatgaatatgccccctgggattctagagtctggaaaagaatgtaatgactttatttacaacaataagaattagagaccaacaagtcaatgccattaggaagcatttttggatttttggtccaaaattttaattgaaaacaagaaagtatgcttataataagatgggaaaaattacaatacggatctcattatttcaactatagatgcaggtgaacaagactagtatggaatttgcaaagaaaaaggaaaataattaatttaggtttaagacgttacaaggaaatgttttgtccctggatcagtgtcattaagtattgctgttttactgactttacattttttaaagtggatcaaaaaccatcagttgtataaaattgaattattatcagtagaatggttttgagagagctgggtgtgatctttagctagttcccataacaaaaatatgttgcatagagtaaattaacatgtgcagaggaattagtatagtgtctggcacatagtggcccatcttgtaattttcattgccattattactaggtaataatgttctaatgttattagaacatgcacgttgtgatttgcccaactttgctactgctacatatgttaaaaatatatgaaggcatttgctgattgctgtgatgtctgctattctagagaggtccatcagagtccttccacctctaaagcaaggggacatttgcatccctcatttgatgtctcctgcaggggattttcctatgtcagaaaagtcctcagtgaaaggtccaaattcaccagtaaatatcttcccagcatttcaaaatatttcactctaaaggtcagatattaaacaaaattaaatattttgctctcttctaccctctctagaggccactgaagactgctggcaaccaggagtcagagcacattatctgttattagcacagagttagctgttgcttggggctgcgggagaggaggctgaagtctattcaattatgtgtaaagaagcgcaatcctggatatttccaagccctcccatcatttggacacatggtatttgggatgctgtaaatgtaaatgtaattctggtatcctatgaagaatctgggatgtaggcttcaaaatagatgtatcatcaatcttccattaattcaacataactatgttgatcattactgtattttactgaccttaagacacaattgttgtgtgtggttgtttcacatttaaacacctctaaatgtagatgtgcaaggaattcaggcagcaaatggatatgctttttattgcctgtgcataaccatcaaaattttcagagtgagcatcaggggcttgaaggaaaatcccagggaaaaaagttgagccctcttgcaaaaaaacgattcttcaccaatacacttgaaaggctatataggacaatattgtttggggacaaaacccggacaatggaaactctgagtcaaagaataatacaacaagattcagtttgaagtgttaaaattttaagacaccttaaccaatttactgtgtgttattatttgcctttttatatgtgtacaagtatgttacatggcaaaacctacatctaaataagactaaaagggcacttttaataaataaaaataatttagtaaataaaagttttagtttaaaaacaagaaaaactggttttagaatatagtttaacctattattctcctaaagaatatagtgtcttctcaggcttaaggataacacaagtcaatggtatgaaaaagacaatgtatatattacacttggctaattatctagtagacataaaactaatcaataaagtggtcttcctataaatacttctacacctgaacaaggatgactatgattcgaaggtccaatgagtcttctacctattttgaaagcagcaaccttctctcaaatgaattttggtgcaacacaatttgaaaatgccactaacaaaaattcactcaaaatacactcactcagaaaaaaaggtgtgaagggagtgcataagaaaaataccacatttattgaacatgtgctagatattgtactaggctttttgtgtgcattaactcattccatcctgacaagatatctatgaagcagatatcaatatccctaaattacagttttaaaaaatgaccagaagatttttctactcgcttcaagtcacacaactggtggagtacaaatatgagatttggataccaaacactatgtaccttaatatatattcttgatacagagtattgaattatcccttaatcaatctatgccaagaatcatcccatacacaaacacacaaactaaattgccagcctcataagctaagagcaagtaataaaatgtttatataagtcaaaagaaatattgagccaagtaatcagttatttcatcagagaatgcattaaaacctaaaatgattgatgatgatgtaaaagaaagtgatcagtggacctcgggatcttgacattgtgtgatacatgagccaaacttgttatggaaagtcctgaaattgtttaacctggtgtgagtgaggggtgggaggtcatgcttttcccattggtgacaaatttttccatttaacagagaaaaaaagacttccgtatatgttatattccattccccaaaatgagctcaagattcttggggaggaaaacacatttatagtgctgacttaacctcagtgagaatgcattattattataaggttcagcacttgacataggctttgtacagaatggctcacattttaaataccaggcacaattactgcatcatgagaagctgatctaaaccacaaattggggcataataggcaggagaaaaaggttgaacagacaaatcattcaataggtgattctgtttaaaaagaaatatttttaaaatgcccatctttgatggccaccaatgaggaaacattaaactagcaaaaagaaaatgactaatacacaaccaagagaagtgtatagtgaagctacatgtacatactttgtatagaagagaataaatcatactcttcataaatatttgcattagggtcgaaacctaaactttatagtcctaggctatccccaagtcaatatactacctctccagaatattgaagaatcttcatttaccaaagaacatagccagtaatttactgtgtattaatttacaatagaaataataaacttagtataataaactcagtcttagttcagatttgcatgaactgaaagagaaggtcaaatctatgggagagaaaagtcaagaaggatataggaagatatacataattgcagttagctggggaacaattcaataggcataggggaaagatttatgacaccaggatatcatcctatggtttcaggcctcaacaaacacatgcagattccctgggaaagagttagaaagaaccagagagagaagcaggaggaggttaagcaggtctggccccagaatctcagagggaaagtggaatgctgaccagaaaacatgtttggaagcccaattgcaaggtttaggtcaaaataagaggtgtcatagaaagggttagagatgagcccacatattggcacctgggacagaggcagcaagactctctctgaatccttatgtgcccttagcacaaaaaagagcacctcgttggtctgtagttgtagtaggggtctcagctgctccacatgagaaacctgttgttgggctgttctgaattcaattaccccagacatggccccttttatttctgtacctaccagaatttcaccttctgaattttttatcctctgtttatctctgttgtgttgaaggaagaccacacaattcaagaacacagtgggggattacctacaccgtgcgctttcaaggagaaaacagaattttttaccttaaagttcctaccaatgaatatactagcatctgggatttcctacctctttgggtattgttactttccaatgatctttttatcttttatctatctattgttcttcctacttttcttcctatcatatctatcttaactgaataatgtctaagaaagatgacctctttagccaacatatatgatgtttagcttccacggaaataatttatcacatgaggagaaatggaagacatgacaatggcatttttaaaatagaagaggaggcagtgtgaaggcatgagaattcagaatgaagggggggaagagaaagaaagagagagagagagagattgagagagagactgatatagtatttgggttattcagaggagttgcaggaatcgtgaaaaaatagtgctgtgcctgtccttttgggcatgactaccatttatcaagtgactattacattatgctgcaggcaccatgccaactgctgtatatgtagcatctcatggacaactctctcatgtatgtgtgcttttatcccttttaaagatgagcgattgaggatccaagagcttaacacaagttacgcagcgagaagtagaggtaaggttctaatcaagttctatagttctgttctctctgctccaaaaccctttctccttccgctattttggtctctctccaaaacatccccaaaggctcattctgcctcatgaaatcacagatgataactctacaaggaacttaaatgattcctgcagcccaatactcccattttacagacgggtcagggaagtaatgtgagatgctcactaaggccctcagcttgtcaaggaactaggtctactcacttcacttccacttaacattcttctaggtgcttactggatctcagaggaagagtcaagaccataacccagggacacttgcaatgcctacccaggtttttcatgtcacccttctactactgcatgcacagatgcagctgtcaactttaggaacactgctttcaaaccttttcgaagttatttttttaccatcttctttaatactatactcctttagagagaaatatcactttctaatactttttaaatttttctatttttatgaagtgttagataaatgttgaatgtatgcaaaacaaacacacagcaacaagaatagccaaagaaaccatttggcttgcttcttctgctgtcgtcttcttgcctttaagcttgtgttctccctaacttttaaactcaaaagaattttttgtcaacattaaaagttttctgataagtattctgaatatgtttactgaggaaaaatttaaataaaaatcattgttcagatgtcactcatatcaatcactctctgcaacagctgtacagtagaaataattgcaaactcatgccctgtactttaaggatgtgagaagaaaagaaaaacaaaatggattatttttaacaagactctgcaagtgtccagcatctccaaagactatcttctgcccatctatttttccagaaatattaatgactattcctccaacgttttccattacgtaacacccacatccctcataatcatcccctccttttattaccattagcattacccacacagttccacactcaactcatttttaccacctctattgttacaccagacacccaacctggcagaaggatcagaaggaaagttgacaagatagtaaaatcaacaaagtgcagacctgaatcacatcaatgccagtgagtaatgtggggctgacttgctgtgaccctgtgaaatttacaagtgtctatatgggtaggtgttcccagtaacatctacccacacagactttgcccatataaatgtgaggtctgctagaaaaaaaaattaacaaagggtaagaataaaataactaagtgagagatggatttcatgggactccgactgtaagtttttgtcccagattgagaaagctgacatttaaccatctagaagaatgcactcaaaatctttgttaacttttggaccttgtcacctacttagaactgtagaacttaaggctgcaaaaactatcttctcttaccactaagccgttttcttagtaagccttttaccaatgtaggaaagaaaagctaacatcttttctctatcatctccatctcctccatgcacccaggagcctcaggagcaccaggctcaaaacccttgtccttgttcaactacactctttccctgctagtggagaagcgctctgtgatacttcactaggaatttggaagagttaatattaaactttgcattgggggccatttttatattttattacactggctgtaaggtgatttcaataatctaagtctattgcttctctaacaggaacaagtaccagctagagatttttcacatacgtgtctaaatatagttttacaatacctcattttaagaatgtagaaattgctcagagagcttactaaggcttgtataaagttttttatcatccactttttgatgtttactgtagacacaaaattgtcccactcatacctctttaaggaaaggcttgctgtccagctgcagaaaatacagtcagtggaggtggacggcgtccagctgtctgcttcttcagagcctgcctcacctgaagcaaggcaccttgcctaaggtccctctttttgccaaggcagatacatgcagtaactgagcaaggttggaaaataaagttttgaccatttggatccacagtgttacactctcagggctggtactcactccagagctctctgctggattggcttggctttgtcaattctctctagtagtttgacttctccctctgtttatccttctcaacctcttttctttcataagtgttgatttctaataaacattttgtatcccaccctttatcttgatgtctgcttctggatgcaaactgctgataccaacacaaccattttactctttttctttactcagataaagcctagaatctataacgcagtgtggccctagcaaggaacatacaaacagtacacaggtgaattattattgcatccagcttcagctggtactactcaaaccccagtgtcccagatctctggacacaggcttctaccctagagagtacatgtctgctttcactcccaggtttttctctcaggttttcagtgactctgagctactgaattcccagcttctaaactcttgattttctcataaatgagtccccaatatctactcaatatgatatttataatgctcattacctgtttttcaggggtccccaaataaaatgtctgctggggattgtccaataaaataaattattaaagttgtttaggtataagacaagagaccccaacctgcttgtttcgcaattgagcattacacctcactacctctccatatgccgtggtgtgagggatactgccttgagtgatctaacccttgcccacctctcatatattccccctcccctcattcaatcttctgcagccacagtgatcttcctgtttctcaaataagtcaagcacattccagtttctatgcctgtgtgtttgctgttctttcttcctgcaatgtacttaaccctcctatttctcatccatcagatattatcttaaatatcaccccttctgggagcattatccaaccaccctatgtaaaataggccacatacctccatacgctgctattttttatgacaggtctattactttatttcatcagacttcttctaattcacgattaatgaatgtgtttgtttacttaatttctgtctcctccactagactataagttccagaagggcagacaacatttttcttatgcaacatatatttctagggcctagcacagtgtcttgtccataatttttgaatcagtgaatttattcctgctcaaactcccttctccaggctccccatcaaacttcatggtggcaccgccatgtccaatccactctcccagggaatgcaattccatcgtcttcaaattgttgtattctggcccagcacagtggctcacacctgtaatcccagcactttgggaggccaaggtgggtggatcaccagaggtcaggagcttgagaccagcctggcaaacatggcaaaatcccgcctctactaaaaatataaaaattagctggtgtgatggcttgtgcctgtagtttcagctacttgggaggctgaggcaggagaatcacttgaacctgagaggtgcaggttgcagtgagctgagattgtgccagtgcactccagcatgggctacggagtgagactccatcaaaataaaataaaataaaataaagttatgtttagccgctttctctccatcttttatgctaccaccttaattcagacactcgtcattccacacttacacaactaccacactctcctcatgggtctccctggttctcctttcttcctctctatcctctgtaccctgtcaaagtgacctttccaatatgcaaatcactcctagtcttaaaacctttcaatggctccctgttgcctacagaataaagttcaaacttcttagcatgacatgtgagatactctgagatcttaccttgtcttcccctctggcttgatttctccatcttctccagcggcccccactgcacaacctctgaacattttcccctgcctctaatcatcctgtccattctaccttctaaatacctcccttcaatttattcactgacctgcatctctacagctaccaatctcattcacccctggcctgagcaacccacacatccttctctctaactgcacactgctgtgtccagtccattttctaaacatcagcaagtgagcttttaatcatagaaatgcttgcctcctctcctcctggcctaaaatccctccatggaaacaagttgaggtttctgcaagatctggcctgtaggtatttctttaccctctcccagcaccactccctgcactcagacccactgtcaagcactttcttatcccagagtttgtgttcctacttacctggggacactttctccctatggcttactatccctttcatttcatagctcaatattctttcctaggcaaggccaagattccctgagtgacgtctcatagctcattggatttttcttcaaggcctttatccacccatataagtgtgggatatgggtgaaagaacaagtttgcagaaaagatacagtgaattatggaccatgagttcgggaaagaagggtaggactgcgtcgctggctgcagtattctggaggctggtctttgggctgtgatcactcttcattctaaaggaggtactgctgagatgttaaaaccattgttttactttttcataattttcagggctttggtgtatcagaaggaggctgtagcatatgatcaactcaaagtctggaaataatttcaatcatgggatttttgtttattattatgttttaatttttgatataagcttcatctttttttaatctgttaaacaaaggaatttctcatcaactcccctaaccttcctaaactacatatgcaattattcattcatccattcatttgctcagaaaacactcattagatgccacatcctttcctagttgttggaaaggagtcacaggcatgaagtagagtgaggtcttaagaccctttgactgtggagtgtggaagaaaaaactacaattgcatcctgggttttagaaagatcgtgaagcaaaagaaggtcagaattttccagtccagagtaacagataaccagtaagaatcacatctgaagtggaaggttgggcagggaccaaatatccaggtcccaggggtagaatcattcagctggagagagcctcttggagctatttcagccatgccaatgattttaaaaagtgtctcctttagggcttggcaggttcctataaagaaaagcatgagatcaaggtccactagatagtggcatttgcttccaggtgagtatcatattcccagcctgattaaagtcaatagccaagaatattgagactaggccactgctgaaggaaaatatgggaaaggattaggtaaggtgttaggacccctgcaaaggtctagctatgacaaaggactagcctactagacagcaacatggggcagattcccagacctgtggacttaaccagcaggacctttgtctaccagcaatgcctaagacttaccccaaactggactgattatcatccatcaattccaagttccaaatagcaaactgagactgtgaatgagacacttagctttgagccgaatgggctccagccgaggcaaactgaggctgcaatggaatggcagggaaaatggagttggcactgtctatgtcctactgtcccctggctttcttgtcttcctgcataacccctggggggaaccatcatccctgtgaatcacggggctgctgcctccatttgttaaggccttcgttctgtcctttttaaatatcactgttaataccccctcgtgacactgtcttggtcctttacccttttatccagatattattaaaaactattgtcaaaaatggaattctctaaagatctcataaaagtcagctgtgaggccctgttacagaggagcgcggccttgtgactaggagccacttcccgagtcgtgatttctgcatcccacagttttgctttttcaaccccatgatagaaaagcctagagcttactcccctcacaccctcacactgcatccttcctgggcttgaaaccattcttaaaagaactgcactatttttttttttaacattctatatgcttcacacttactcgtttcatatttttatacataaaatcctcccactctctctccatcacaacctcactacctccctccacaaaatactttttttttttttaacagacattttcagaacatcagggatatatcctgccctgggatgctgatgaatggccgctttaagactcactgagacactttggtgcacggctcagagtgctctgaaggagtagttttaattcagcagttttgatgtggaagcaaaaatatataaaatggcattatattgctgggtaatgtgttgtagcactatgaatttaatccacagcagccaggcacacaaaagcttacatttattattttttctttctttaatctttttttttaaaaaaagaaaacaacttttattttagatttaggggtacatgtgcagctttgttatacaagtaactcatgttacaggggtttgacgaacagattattttatcaccgaggtactaagcctagtacccaatagttctttttttctgctcctcttcctcctcccaccctacaaattaaatctgattctaacgtggttaagagaaacagtttctattatattcagtgatcctttcatctccccaaagtcacgaagtaagaataataataattattttagctatttcattatagtcagttaaacatggttaacacatagcacactgtggttcagacaccatctaagtgtttcatctttacaaactcacttttcacctcaaccaccctaggagttaccattatttttacccattttatagatgaagatgttgaggcacaaagatcttcagtccaagctcacagagtacacacagaagctgacatttgaacccagaaggcttgttctagaatatctgctcttaataactatggaaaataacaatcctagcacttagaggtcacctagcaaaatggagaaaggccttgtccttaatccaatgtgtctgccatagttaaccttagtctcctgatccatggggtggctgctgtgcttgaatgttcttatggcctctggcccctcatgggtcctccccctgatcaaaggctcaacacaggggtttggcccacttccctcaaggctgtgggtgtccaggtttccttgcatcccattgaaatcctccatccagggcaccatgtgcagttagggtatggatctcccactcacatgaaaacccctcattaccaatgttttcctaattcacataccagtcctttaaactgaagcttcagttcctcccatcctcacctctaagcaccagtctccagattccttccctttgagacaatccaaaacaatctcctcaagtaaacctgaagcacgaactctgcttatttcctttctgctagttgtgaatttgggactggagggtaatgagctctctgtttgctgcaatgggatggagaaaatacatgatttattcagcaatggtgaatgcacagtactttttcctcatctttaacactgatgtacatggaacagtcctcttcgagccatagcatacccctgaccccatcactgagctcttcctctacctctcacctccatcctatgcccatcccatcctcaccgagcctccaatcaccccccactgccccttttttcctcggttcttccccagccctcatatgcaccctgcacatttgggagaactgcaagcatagctcctgccttttgaaaactgaaataaaggaaaatgattaaataatatttattctacatttttgataaaaaaattttttcaggtaaccaaatagttggggataagaaatacccctttagagaagttttacagattataaatgaaggcaggatgagaaaatatcaccacttttgtgaaccctaatgaattaatccatctaaacaatgatcaggaatggctgccaaaaccaccaaaaagagaaaaggagatataagaaggcattccctgcttcctaaccaaaccaaaccattccctgcttcttgaccaaacgaaaccaaaacaaaaaagcacacaaaaaccctgaatcttacaagtctgtaaatctatgctgttctacaggagaccccagccacatgcagctattggtcacttgaaatgtggttaattctgagagatgctgtaagtgtaaaattcatactggatttctaagatttcatacaaaaaaccccaaacctcaatgattatcatgattgtatgttaaaatgctcacactttggatatattgagttaaatgaattgtgttatttgtaaaattgcatctctaaaccacatctcacacctcccttctgtctgatcctgaagcctaattctgcttcagaagcatgggtaagaatcaaagcaagaaacattattacttaggattggggtaaaacttggcagcaaggtgaagttcaacatcagggtcaggtttgattttttttttaagttaggaatgtatcaggttctttcaaaatatccatgcttcagagtggggatagacaaataccatgtgctcataggccttatgatgggtaggaagaagtggagacaaaaggagaaatcttgaggaaaggccccaggcaacatgaaaaagccgataggaatggtttggactagccaggcatggtggttcacacctgtaatcccagcactttggaaggccgaggcgggctgatcacttgaggtcaggagtttgagaacagcttggccaacatggtgaaaccccatctctactaaaaatacaaaaaaattagtctggcatagtggcgggcgcctgtaatcccagctacttgggagcctgaggcaatggttgaacctgggaggcagaggttgcagtgagccaagattgcgccactgtactccagcctgggtgacagaggaagactctgcctcaataaaaaaataaaataaaataaggaatggtttaagctgttcaggctgcactggcatctggtcttcctggtagccctaactagctttggccttgattttatcttcccacctcctcagctgtgttctgcatctctgtctcatcctcacccctgccatagggaatgttgcttggatatttgtttcaagacaattgtaaaattcagaagggaccacagagaattattgcttcatttgaacatcacagagctagctcagtagtggggtgcagctgtctaggatttgacttttagtagggatagtgtgatggatgtgctgcagcatcacccagcctggctctggattccttctccatcacttaccagagtttctaaataaagtcctgcatcagcttgcccagacttgtgcagaaggtaagtgacaatgacacctacatagtgcctcctatagtccctggctcagaggtggttttactgtgatgctcatgaaaattcaggttcagggaccctcatagtacagtgactccttcctagtgcccttgggaaggatttttagcaaattttattaatgatatagtatctttctcagagggcttttaaaatgtgcttaagctcaactcccccactcataaaaaatggatctgaaactactttggcccatttgagttcttaataaatatatctgtgtattctgtccttgctcgtacctgcctctttatctttctatattactctttagtgcacttctgcagggtccaaatgtacctacgattcccattttctatcttccctaggtcctgtttatgtaagtggtaggcagaataatggactctcaaagatgtctacaccctaatccccagaaactgaatatgtcaacttacgtgacaaaagagacactgcagatatgattaagttaagaatcttaagatggggtggattattttggcttattcaggtgggcccaacctaatcacaaaaccctaaagacagaattttcttggctgcctttaaagaaaaatgctctgttgttggcttgaaagagtgaggaagtggccacaagccaaggaatgtgggcagcctcaagtagctggaaaaggcaaggaaagagattctcctggacagcctggagaaggaatgtagccccaatgataactttatttcagcccattaggacccatgccagacttctgacctccagaactgtaagctaattcatttgtgttgttttgcgccactacattcccagtaatttattacagcagtggtaagagacaaatactgcatgaagatctgtttttctcttttcatcttactcttccagctgcttgtttattgatctgcctggtgatctttttattctttttacctcattttattcttttacctcctggtaattgtatcttttctctgtaagtcatgcataaaaaaacaaacagggctttctcgctggcactacccctttcatataatttattaagagtcctcctctgaaagggatttgcttaaagtccaatttaattagatttagcaccctgatatattaaaaatcccttagcatgaggcagctcttgcttatgggaatacaccctgaagtcaatgagaagctcaaggtgttagtttcaaattttctattttatactcttgtgacttttggcaacttaactaacctctctgagtacaacttaactaagctttcctagaacaaaaaactcacaatatattcatttccattccttttattgtgtttttgaaagatatttgtccacccaatgcaagtggacacttgacaagaccctgaattgaaagccctgtttgtgtttccctcccttgtttatagctggttttatgactccatcttaaatgtgcacgtaaggctcctgtagatgctgatggtgagtgatggggtctccgccttttaagtaaagcatgttttcctagaagctcagagtaagatctaattaaagtttgacacctcacatcgatggtgacctgagggttgcataacgatacctgtgtcaccaagtagttgcaaaaattaaatgagactcgtggaaattatagggcctgcacatagaaggctctcaatggtgaaatcacaagtcaaggagtaagcatgtcactcttttcttttcagaaacttgagtgtatttgaatatttacaaaatcatcccttcgcttttgcattgacaaaccgcattatctgaatccgcttagtggatactctaaatgagagtctgtatgcaaaagcactttgggaaggtaacaaatgctagatgtaactgtaaattcaaatttttaattatatattcatttttgtaaatctttcattcccagaatagaggcaccctattagtagagcgtgaaatgaaatggtatgacatgctgggaagataaatgtttatttgggttgatcagtttctccccccatgacatctgaagctcactcctgagatgacaggaaagctttaaagaaagattgaatcaaacttgcttcccttttttgtcttcctaaatgaaaaggagatgaacaacagtgaagtgttttattatttttttcattgatgtgtcagtgacttgaagagttagtggtgagcaattgtaaatattgacatccagcaggccaggaatcaaaccccagacctatctcttgaaagataatgggaacatggactaacaacgttagagctaaactttctttaacataaaatgagaataataaccatagattttcaaacgatgtcataagagtgaaatgaaataatttctttttaaaacggtagtgtggtcagactattccaaccaatacattatttgccaagcattatggagacagggatgaagacagcacacttcctccagccagtgacaatacaaactcaatgtctggtggaagaaaacaatgagtaagccaacaattatggtctagttatatgaatgtttgatttgaggtttcctttgttatatccactaggagatcgtttcctagggagagggcttggagagatcagcagatgagagaccagggaatctgatctgatccccctaaaacaaactgcagggccatcagagatacaatccctacagagtttcctctgattttagcatcatgatccttttagcaagttcagaatcacttggagaaaagagaagaaggtattgtcctcaaaactgacaccgttcccttaattaactcatcaaattttgtagtacatttgcttctctgaaggacttgtcttataaatgcacttctctgggccccaaagtgaaagatcagctttggtagttcatggtggtattctggtacctgtatgttaaacaccgttcccaggtgatagtaatgtgcaagaaagttcgagaggctctgtcttgaattctgcaatatagatgtgtcagattctttcataatccgcaaagacatgtgcctcctttcagtcatttgtgaaaaagcatctttgcctttgttgagcagcacttggtatatctttgctgagtagccctgtgtttctgcccttggctacagagattacccaactgcactcacagttctccaggtttacacagtttctccaactgtgttgaagtttctgcaagtacatgcgaagttacacagagatgtgtaaatttccctgattgtatgcaaaatcatacagatgtgtacagttttcaccacatgtgggtgaggttctccaccatttgaataggcccccaactggcctgtctcttcctcatcaggagcttctctcacttggattcaggaacccatgcaaagggttcccttttatccttgctttattgtctacacctgcattttcctgcctggtgcatgccctttgtgaaaatagctatagtactcactaatttcctccggaaaataaaagctaacccatcgccttgccctgcctcaactgtagatcaattcacctctgaatttccctgaggatgctcttttcagattggtgtgcttttcagattggtgtggacaaaagcagaaaggggagcgctgaaatggaggggaaccccctccacattgttctgtagctatttgggttggttgcaacccacaacaagaggaaaatgaaagtcctgtctgggtctgggatgcctctattcagtggtttgaggagaaagcagcgtttaccgaccctgccactgaactgggagggagagggggtagttaagccattggtctggaaaagctctctggaaaaggtgatcacagactattaacctggcagtagattggcagcacatgttccacccaccagctaaagtgccagagctacattaagacccacaatactttccactggctaaagtagatagtattccaactggaacaggggagaatctaagcttagaaacaataacagctaaaaacaataaattgaaaccagaataaataagacatcctcaacagattgagatctgatgttggagcctcaatgcccctgcctgccgaggactcctgcctcctcaatgaggcaggcagagctgagctttcccaggagtcttagagtttgcacagacataaggacagaaaaggaaaggaattaccacccttaggagtgatctacaaatagcatcccaggataaggacagggcaggctcttctctttagcatctagagtccataggaacagtaaaaagtttaaatcgtggatgccatttgtttttctagacaaagccttctgctttcatcccaggatttcaaagcccctcacagccattaattcgtcgtaagcaattcaggcctgtcaacgtttcacacctaatcaagagctgatatctgtcaccccaagggatctaaccaataattcctctgcacgctctcctttcctatacccttctcccaagtcagttatttttttattttatatatatgcatattttaaacttcaagatcccctcccccttctttttttgtgtgtatgtttttttttgtttttgctcttgcagtatctgactccctttcccttttcttacccttccttttctgcctcttctcccaaggtttctttgtttgccttcttattttccctggatggagttgggaggaatctgtaaaccaaggggcttgagaccgacatacggaagtccatgagtcccaggctttcacagagaaagccccaaatgaagatgggttcctggccatgaatttctatttctcatgggacatgattatccgtgactaatttgtctccctgggcagacaaaaccactgccaatgtaccagctttagtaaagctgttcagggctgtgatttccaaggaaagtaaaaaaatccagctctatgttttcaacaggctcaagacttcctcatgccctcagtaaagacaaaacctgattccattgcaataaatcacttagagcaggaatgataagcctgctgcacaggtctatcactctcatctccatgcccgtgcagacatcactaatcaagcatagcactttcccccacccccatcccatatccacctccctgccacagctatctcagaccctgaattcctctcaagaggaaatgtgaaaactccttgccatctctgatgcagggcctttcctaccttgctactcaccacatccacagtccatctttcttattttgtttgtaaattttaagcttaattattttggactttttactatatgtaatatatttaatataatgtttaatgtaaaatactaatatactaatattttatgttcttaagcgtaatcataaaactaatatctattaacttactaacctaaaataagaactagaatattactaataatctgcatttattgaaagatttgtctccacccacaccactgccttccatccatgaattaacacctatcctgaattttgtgtttaacatacccatgctggctggcatatgtgtgtgtgtgtgtgtgtgtgtgtgtgtgtgtgtgtatatatatatatatatatatatataaaataggtatacaccacaggcaggcacataggtataccagaggtatccataggtatacaagcatacaaatatacaattttagcacatatgtacacatgtacttgtgcatataattttaccacataagtatatatgtttgagactatatacttattctcaaacaatatatattttagttttgcttatttctgaactttcagaagtaatacatattatcttgcacatagcaatgctgtatatattttcactgatataaagtattacattacaaatatgcaacccaattttgttccaggtattattcatatgatcaggctttttccaatcagattaactgtgaaaattctcaaatattttcatggttcaactgtacaaggtgatttctaacatgcatacttcagagtagaattgttatatgctagaatttgtgaatgctcaaacttaccagataatgccaattcatttaccagaataattgtgtatatttacaccctcatcaacggttttagaggatttcctgtcagtgcctttctctcaaatacttttgatttttatacattttccaccccacctcaatctagaggatgtaaaattgtatctccttgtggtctttacttgcattccctagattaacaattagactggacacaattttattgatttatggatcatttgtgtttcttctgtcgagtgtctgttcaggagctttttcttccccccttctctttttgttattaatgtcatgagttgagatctgtttgtttatttaatatatcctggattttaactttttgttagatagcaaatcttaaagattgtgtcctgtattttcactttctttatggatcctgttaatgaaagttcctgatttcatcactttttttttttttttagacggagtctcgctctgtcacccaggctggagtgcagtggcgcgatctcagctcactgcaagctccgcctcccgggttcacgccattttcccgccgctgggactacaggcgcccgccaccacgcccggctaattttttgtatttttagtagagatggggtttcactgtgttagccaggatcgtctcgatctcctgacctcgtgatccgcccgcctcagcctcccaaagtgctgagattacaggcgtgagccaccgcgcccagccttcatcactattttactaatgtatatggtgcttttgaaatataagtattaatcttttgttaaagataaaatatcccaagtatgtgacatattttcatatgtctgttaataaacataatttttttcttactgttctatttttgtttaagaaattattttctacacaatggtaaactaaagcaaagtgatgttgtcacttctggaaggaagaacataataattgccagtgttgagctcttcagccttgtttttctgctgcatggagaaccctgaaggcttatgtcgagatgttagtgtcaaaaaaaagttaaatcttccgtcaacctgtgaccctgagtgacatctacaaagaatagaatccaatccacttcccaccaactcaggttggacatatagtctgagtaagactttgttattttatgccactaagatgtgagggttgtttcctaatcataacctatcctatcctgacaggtatagtaattgtctcagcacactgactgaattactcttctgtttctcaagggtacaggatacttcctttctcacaaatcaactttctatatgtgtgtgggtctgtttctggaatcttgttttgttcgaccagccaaattgtctgtccctgaacaaatattatactaccttaattactatggtttcatatttgtatttgaaaaagcaaaccttcctatcttattcttcttcaagaatttgccgtgctttgaccctttgctcttcaaaataaatcttgtagtttgccaaattacatgacaaaccccattagatttaatgagaatatttatagatttactttgagtaaaactgatatttctgacactggctcttccaatctagaaacatagcatgactctctatcttgtttatttttagttatttcaataaactcctatacttttccagacatagtatacacatttgttttatttatttctatgtgacatattttgagttgacttctaattttaattgtgaatgacagttttaaaacttacatattccaatggtttcttgttgatgtatagagaagcaaacaatttttattttttattttaaagccaactaactttttatcgactctcgtattaattctaacaatttgtggattcttttgattttctaagtaaacaatgatatcatctgcaggtgatgctagcttggtaccttccttttgagtttttttgtcttaatttctcttccttgtcttactgccctggctaggaccctggagccatgttgaatataaacttcatgtttatattccttgtcttactgccctggcttggaccctggagccatgctgaatataaacattgaacttctcatctttttctagtccaaaggaaatgattgtcacacttgaccattaagaaagttacttcaactaacaaaagaaaacccaaggatggaagtagaacagttctattgttcaatctggaataaagtaatgaataaaggcattggacatctgtgacctttaacatcacaataaagagagaacagacattatgtgactcccggtaaaaaaaatataaccccctagaatctgtcctgccaaagagattggacttaaatctctgtatccagctgccaatatacaggaaatgcaaaagataaggaaaatgttgagctacaccatgaggatgcactcagcaaaatccaggctatgaaggagtctataggttaaatgccctgggttcttccacaaataagttataaagaaaggaaaagatgcaggaggacctagagattttaaaaagttaaatgatatatgttttctttaaaccaaagtgtccaggatgagataactgtaacaagaagtaaagatgtaaatagtgataaaaattacgatgaggtttatcattgagaggagagcaagggttgttatagaaacagggcacatggtgggtcttccatgatggctagcaaagttctctttcttgaactaggggtggcgattgattacaaggaagtttgcctcattaaaaaagatcattaagctatacatcttgggtggttttcagtatttttattttattctaaaataaaggtgaggaagttctatccctatttataaagattttttttaaatgaaggatccacatttaattttttcatatgttctttgtgtatcttttgaaatggccatatgacatgttatttcttcttacatgtactgatggtacatgtaagtacagggtactgatggtacatgtaagtacatggtactgatccatgtacttacatggattacatgtactgatatgctaacatgttaaaccattttacattcctagaataagaaaacagccatttttttctatgaactacaatatttaaccactgctagattctgtttgctaaaatctgcattcttgtgcatgaatgaggttatcatctactggctttagtataaaggtaatatcagctttaaaaaatgaactaagaaatcctcctctgtttctctctaagactttgcataagattggaattatctgttccttgaaagatcggtgaatatcacctctaaaatcatcagagtcaggtattttcatcatgaaaagatttttaacttctcttcaattactttaatagtcttatgttaatagttatggtctaattaaagatttcttatgtcttcttaagtcaattttgttgttatattttcctaggaatttgtcttttttatgttttttggtgtattggcatgaagctacttacagtattttattacatctctttaatctcttctgcatctatagcgttctcccctctactatttaataatagtgtcaatttgtgttttatctctctttttctttttctttaccagaaatttgaattcttattagctttgtcatatagcaaacctttggtttttttatattctcagttctgtatttgttttcagtttcatttatttcttctgtatgttcatcttccttctgcttcatttaatttgactctattgtttcttttctaacttcttgagctaaatatttaggttatttatgttaaatttttctcataaaaaatgtaatcctagcaaatgttgctacatctcacaattttgatatttagtattctaagtagttttatatatttaaaataattttcttactgatacatacattaataagtgtgtgttttattatatcttattatcaccttttaatgtgattctgttttgtctagaaaagttatgtttgatatcaattttttgaaatgttttagaattgtcgtatggtataataccttttaataaatatttcctgggggcttgagaaaaattcttattccctagttagctgtgaacattaacagaagtttattgtcctaattgttttaattctatatttttattaagacttttgttcattttacctatcaaaaattgaattgaaatcttccactacagtgattgatttgaccatttctttatcaaatctcatcaattttgttgcatatatttggggatcttttattatgtgtgcactagtttagaattattatacttactagtgatttgaatcatttctaattatagtataaacttctctatttttcataatatgttttgtcttaaactctattttatcttatattaatataagtactctagggttttttttagtgggggtcagtctactttacgtgaaacaattatgtgtcctccagtttcagttgtgtctcttggaagtagtacataattggagtttttcttaaaaatccaatcttaaaatgtcaattttaacagaaatgcttatatatttagtttattgaaattcttgtcatatttgaactttttctgccagtttgattcttcctgattcactttttctatttttctattttcctttgatgtttcatctttttcattgtattggcttttatgtcttttgcattttactgtattttttttcttccttctatgttttagctactggtttagaatttatgaacattatctctagggcttcaatggttacccttgaggttttacatttcaaatatatataaattatatttagttagatatatttaactatataaatattaaagataatcaatacgttaaatcctgtaactaataaaagaatattaaaactcttacagttcagctgtagttctttcagattaaatgctcttcttacccactgtttaaaccttgtctttttaaacctccaaattgaacattattttataattattgtatgggaataatcatatttgcatgcatatattttattggtttatactgacatgcatatttacaattttatttgttcagtattgcttcttacttcacagactatcttctggaatatatttttttctaaagtacattctttatcagtctccttattgatagcctatcagcactaaccttcctctgcagtgtttaatgtgtgtgcttgttcttaaaagtgcctttatttcatattcattagtggctggtgaaaatgctcacacatgatcaaattctaaaggcaaaaatcaaggcagagcttgatatttaaacaagataataggtacaataaaaataatgcaattttaaatatgaaggcagaggtatggtttaagttcttcttttggccttggataaattattcagtaatattcattaatttatgtgtgaaataaacatatggtgtgtatctgctaattgcttggctctgtcctaggtgttcacaattaaaaacataaggcatggtttctggctacaatgagctcagtctataaggagattcagacacattaatcagaaagttaaaagatgattttgtaacggggatatctatttatagtatcttaagaaaacgtccatgggaacatctacctgggtttgggatggggaaggttggtgagggttggcttcctggaggtcatgtgagtagaagaggaaaacgtatgcctaaagaggaagaacagagagaagaaaaagaaaaaaggaagaaaagagaaaggcccagtaacaaaaatctgaatgccatgtatagttaattaataacatgaaggtggggcatacatttgaggtcataagatgttagaggtttaagcacgggccaggtcatgaagggtcataaatgctttgccaaatgttttggactttatctcataggtcatgaaaactcagtaaggagatgaaatgataatgacaaggtcatatttatgtttcagattgttgactccagtgagagtgaagaggccggatgggggttggagaggcagagctggtgtcccatctggctctgaaccattttatagtccaggcaagagctgatgaagactaaatgaatcagtgatgttattgatggacaggaagagtataagaaacaaactctgcagatgttttttttttcagccatactcatcacataagtggtgagtaaaggagagaagaagcaaaaaataattcattgatttctagctctggtattggatagatggtatggccactaccccatcaacaaaaagaatttaagaggaaatgcagttttaaagaaaaaaaaagttgaatttattttagaatattttggattttagatgccaatggtcattaaagttgaagtcattgaatctgaaatgcctatcttcaagctttagctttctaacacaggaaggcatttatataagccaaccctagggcacagctatagcatataattccaatagaatattggggttctaaatttttggtataatatacctcataacaggctctagagtatccaaagccaagcctctctgaactctgaatccacagggtaaggagggaagcatcatgctggccaacacacatgcagtattttctttctctcatagtctctggtctctaaaaattgaagctcatttggcttagatggcctagtttaaggtcatttcctttacctacaccagagtctaaggtggcacatgctttatcaggtgtttgtgtaggcagggactttacctgtgaccagtataatcaggcttcataatgtgtctttacctatttgcttaggaattatgtgtggcccacaaaacatggcccaggaattattttatattcctactttgacattctctgcaacgactatcaacccttgtcaccagaacaactcaagccgttctctctaagacctgaaacatactctgtaaatcaatcctactcattcatacactgggagctacccagacccctcttagttatattggctgtatgcttatcagaatttacctgaaagtttctccatgcaaaatttctccccatagagttatccaagaccaaatgatatgggttctatatttcctctggagctggaatctgagtgaattatccttagatcttcactgtcattcgagcatcacctctgaaaaaaatctctacgtttccaaggtcgcccctggaaatgtttttctagaagaaccagatatatgactcttccaccttttatcttttagaaaccagagcaatgcaataggaatggtaattttgatgccctaaccaaagttttatcagactggcatccaatcaaggatttaaccacttaaatattgtgctttgataaaagttctactgagaatttgtgattattggagttcttttacagggtacttcataagccattacataagacactaattatccaatatttctaccagcaggtgatcttgtactaattaaattaacattgaaaactgctaacatcattgattaagggtccaaattgttactgtatatcagtaacaattaggacaacttcattttgggcaaaaatcaaatctgcctttccctttatcacaggagattaattatcatcttttcctaagaaaccaggctctcacctaacaataaaggctcttgtgatttgtctacattttggcctctaattatgaagtttgaggatggcagtcatcaggttcatggagtggttaatatcaagaaatctgacttcagatttggttgaacatattcaaatctcagccctgccacatagcagatatatactcctaagccaagcatgatcttccattgggctcagtttctttttccattgtacagtaataaaaatagtccctaccttaaagggctgtgatgatccctaactgaggacagccttgtaaaagagttaattatcagcctgacacatgaaaagggctaagtaaatggtggttattgccattatcagttgtgtttctcattctcttgtgctaatgatttaatacacttccaatatctcttccaaaaaccttaaagttggaaggggatgttgagaagatcaccttaacgaatctttaactttactgagaagcaaaagtgctgacttaataggatccaagggagactccagtggctggtcattatacctggctatttccctttttgtaaaagtcatttgaaaaacattgaataacaaataaccatgaagactttatgatcaaagattcccagaactactgtgaaaaggggaaaaaccatggaagtccatatttccagcccagccacactgtggacagtcctcaccttcctttagaacttttgctcccaaatacagagaacacctgtgggtgatttggagccattgtttttgagaattattctcataacatcaattttaaaatatatatgtttaatctatcactctctttgtgccagccatcatgctaaacttatctgcattatcacattctgtcttcatttgaaggaggtattaccattacctccaaggaagtataattattcccattctataggttaataaactggactcaaagagggtaattgacttttccaaggtcacccagctagtacatgatcaaggtggaacttgaatccacattgttcgcattccagaacccacagccttaactaccatgcacaccacctccatgggtgaagaccctcttctttcctgtgggcatccttgggagacagaacacccaggagctcctgagtaccatttttattttggactctctgatgcccaggatttttggtggcaattcggccacctttggataagtttgacatcttcataaaattcccattagccctactgcaaaacagtgtaaatgagccatcatccaaattcccaaatctatccctggccttcactccttacaatttgactgacaaggtagccagtaatactatgtacccagaagtttgcaaattaatgtcttcttctggccctccctcattctgtcagagaccctctctcccaagccccaattaccaaacttcatctgaagcctcattttcaattctcttttcactagaagttccaagtgtctcctaacccagccttttcaaaactgacctaccctctgtaatccccaaatctcccttttctctccactctgcctcaaacccttcgcagggcccaccttcctcagatcctctttttcagtacccacattctacacttgcattgcagctcagcctctccttctgtgcctccccgtccacccccttacacgctcaggccctataactaagcactccatctaatggaccttcttacttagcctcaatgtttgctttccgatacattggatttatagagtgtttgcctgaattaaaatgcgaaattttagagcaaaccaggcttctcagctgctaagctccatcatgtactttaaataaggaggagggggagtgtgtgtggaggggtgcctgatgcattgacctacccctgaattaccatctcgacccaggctgctcaccttccaacccagctggtgcctacctggccctactcacctcccccagctaaattaacaaagcagttactgctcatccgcagagctccctctaatcaactcccagtgaaataatatttgctttccatgcctactttgaatcccactcactttgttaaaagattgcctctggctgtctctgctggcctaatctaatagtttctagtttgtacaagcaaagcgttttcagccacctatataaataacttaagcaggagaggacacttgtacagccccagtgcagggctataggacatgacagatcccacaatgactccttggccaatctcctgggggagcaccacccgctgagtgggagcaattactgtactccatgaggctgacaggacagtctgtctgtctatagaaagtctgatgggggaaaactattcccgtctgttttctccagtgcaggtgaccatcctaagtgcctcggccccctctatacccctccatactgcctgatccatggtctcagagggagcctgttcaaagtagaaaaagcggagaggaactaaatcaatctattagttttcctctaaaaattgtaatgcaatcaactttgcttttaaaaaattgtggtaaaatatacataaaagattaccataaaagcttaccatcttagccctttttaagtgcacaattcagtaatgttaagtatattcataatgttgttcagtctcgctccagaacatttttcctcttgcaaaactgaaactttgtacctgttaaaatgacagtttcccattttcctctccccccagcccctgagaacccccatttcactttctgtctctataaatttaactattctatgactgcatagaataagtcacacagtctttgtcattctgtgactggctaatttcacttagcataatgtcctccagggtcatccattttgtcacaaatgggggatttcctttcatttttcagttgaataatatgccactgcatgtgtagaccaatttgagcttctcattcatctgttgatggacacatgagttgcttctaccttttagctattgtgagtaatgctgctatgaacatgtgaacatggctgaacacatacatctttgagactctgttttcaaatcttttggatatatacccagaattgaaatttctgaatcatatggtaattctatttttaattgtttgaggaaccactgtatggtttttccatagcagctgcacaattttacattcctaccaacagtgcaaatgggttccagtttctccacattttctccaacatttgttattctcctcctcctcctccctcctcctcctcctcctgctcctcctcctcctcctcctcctcctctgctgactgatcagggtgatggttgctgaaggttggagtgagtgtggcaattcctgaaaacaatgaaatttgctacatgaattgactcttcctttcatggaagatttcttggtaacatgtgacactgtttggtaacattttactcacagtacaacttcttttaaaagtgaagtcatttctctcaaaccctgctgctgctttatcaactaagtttatgtaatattctaaatctttttttgtcatttcagcaatgttcacagcatctatgccagaagtagtttccatctcaagaaatcactttatttgttcatccataagaagcaacttacacattcaagttttatcgtgctattacagcaattcaagtcacatcagcatgcttatattctagttatcttgctctttctactacatctgcagttactttcccctattgaagccttgaacctctcaaagtcatttatgaaagttaggatgaacttcttccaaacttccattaatgttgatgttttgacctccaccatgaatcaggaatggagatctagcatagtgaatcctctccagaagattttcaaattactttgcccagatctatcagagaaatcactatctgtgtcaactacagctttgcaaaatgtatttcttaaacaataagacttcaaagtcaaaattactccttggtctgtgtgctgaagaatgaaggcatgaaaacaacattagccttgtgcatctccatcaaagctcttgggtgactaagtacattgtcaatgagcagtgagattttaaaaggcatctttcttttttctgaacagtaggtctcaagagtgggcttaaaatattcagtaaatcatgctgtaaatagctgtgctgtcatccaggctttgtttttccattatagaacacaagcagaatagatttaacataattctgaagtcctctagcattttcagaatggtaatgggcatgtggcttcaacttaaagtcaccagctccattagcctcttataggaaagtcagccgtcctctgaagcattgaagccaggcattgacttctcctctctgctaatgaaagtcctagatggcactttgttctgatgtattttatctacatgaaaaatctgttttttaatgcagccaccttcatcaattatatttcctagattttctgaatcacttgatgtagcttctacatcagctcttgctgctttgccttgcactttcatgttgtgaagacagtttctttccttaaacatcatgaaccacctctgctagcttcagtcttttcttctgaagcttcctcctctctcttagtcttcctagaattgaagagagttagagccttgctctggattaggctttggcttaaggaaaggttgtagctggtttgatcttctatccagcccaccacaactttcttcatttcagcaataagcctgttttgctttcttatcatttctgtgttcatcggagtaggacttctaatttccttcaggaatttttcctttgcattcacaacttggctaaccatttggcgaagaggcctagcatttagcctaattcagctttggacaggacttctgcacttaacagttaaatcatttctagcttttgatttaaaatgagagatccttcctttcacttgaacacttagaggccatttagggctatcaattgacctaatttcaatattattatgcctcaaggaataggaaggcctaaagaaaggagagagagagagagagagagagagagagagatggggcaatggtcagttagtggagcagtcagaatacacacaacattggtcattaagttcatatgggtgtagttttgtgcccccaaacagttacaatagtaacatcaaagatgtctgatcacggatcaccataacagatataataataatgaaaaagtttgaaatattggaagaattaccaaaatgtgacacagagacacaaaatgagtatatgctgtgtaaaaatggctctggtatgtttgctcaatgtagggttgctacaaaacttcaatttgtaatgtaataacatgaagcacaataaaatgaggtatgcctgtaataataattgtaataatatattccaggaactgttccaaggattttgcataccaacttactttcaacaaagtggtgttggttgcgtttatttaaacagcactgaaaaccacttaaaattggatattagatagttgggtcacattttcaagaactttgcttcatgcctggcaatttttcctaggtctcttcttttctcttatattttcccctctccattcacctgtctcagagattcccaaagtgctgttcacttttcattgagggactcttaaccctttttcatatatcacagtcttttttcagcatcttgcctgaggtcttaccttccacatctaaaccaagatatcaaataatctgtcctggatctcccaatgtccccctccatagggaaactcagagccagtgggatgatgacaaatatttcactctcctttttatatataaaagcaaggcattaggaggcacattttccagggtatacaacatggagtacagggtaaaagtagggccacaggattcctgtgctaaaaatgagaaagaaaacactcagcttctgagaaatggagaggggttagggagaaggagaagaatgcagcaggtattgactgctcacagtgtgctccgggctgtgctgtactttatatgataattttgccttcacaaaaactcaacaaagttggtactattatccaaatagcagagctgagtaaaatgaaggttacaggaattaagcaacttccccaaagtcacacattttgctaacaacagacaacagattttaaacgtctgctctttccactacatcacgctattatactttgtctagatacatatgaaagaaaagattgtttaaacgctcaatgagttgaccttaatttgctgtggctatcattgtgacctttcagtggcaaacgccaagatctcttattctctgtgtctgactcatatttccacgcaccctcatcctcataggagcacgtgcaacaactctccaataggacttaatagaaacaattttcaacaacgtttttactaatttcccttttaaaaatcaataaatggttagtgatgccattaatagagtgaaagcagatttctctctattatgagagttcatatttgtagcatttatcacacacacacacacacacacacacacacacacacacaccagaaacaataaaaataaagacaaagaaaccactgagtttatgagaccctaaatacttggattgaaatttttgcagcccaaagagagggtaatgcaataaagagttctgtctcaggggtcagaaagtcatgagttcaaattccagtggcaagtcttcccaccttaaaggattgtattgaagattaatgtgccagggcattaacagcacttagcccacggtagacaggagatgctgtatcggggctagtcacagatgcagttgaactggtctccttctgtgacacttcctttttggaggcccaggatgtctctccccttctatgcacttcaattccattcctgacctaagttatcccactgctaccctctgcctggtcagcagccagcctctggccctcatccttcctcctccggtttgtgactcactaggtgacttccggaaaatcagttccattctctcaagtttaatattcctctcctttcatatttattataccattgtcagatgcggcccagaagtgatttttaaatgcctaaaactagcttctgatctttctgaaacaacccctgattgaatatgagcgacgttttttctttctttctttctttcttttgagatgaaatctcactctgtcacccaggctggagtgcagtgatggaatcttggctcactgtaaactctgcatcctgggttcaagcgattctcctgcctcagcctcccaagtagctgggattaaaggtgtgcaccaccacactcagctaatttttgtatttttagtagagacagggttttaccatgttggccaggctggtctcaaactcctgacctcaaataatccgcccactttggcctcccaaagagctgggattacaaacatgagccaccacacttcgcctaaatatgagaggctttaattttaatgatgagcaaagaaacacttttggggagattatttttgcagcctggttctggagaaatgcatggcttccaatgagatttcagaaatactgagtatacaacaaatgtcagaggaatttgaagggccaagttatccctagtaataaagagcttactcagccacacctggagaaggctgtgcagatgtcagaattcgatcaaataatattattactgaatgatcagagacagagagttactaggcaagaagatccaggtgagaccagaggccacaaactttgagggacatgcaccaccctggagcagagaaataaataagagacaaagtcagccccagagtagaagggaggaatgcaacagtatttacattttcttgcttgctttgattagagtgaggtctgagactatccctcagcagtttcccttctgctaccctaaaatcaggacagagtactccaggaaacctggatctaggaaaggatctagtaacctccagacacatgctgaatgaacctccttccctggctcattccccagcagtgaagacacttctaagttaaagtctacattcccagctggaaaaagtcatgaggtacctgccttcttcccactcagaatctactattttatatgtgtgggggaaggaaatgggaaaatatcaccccagccctgctgggagggatgctgaatcactgagctcatgggatgtacccatattaaagaaagtcaactccagaaaaccaccaccaagtgttagcaagcccctgttccccagcagtgccaccccaaatttctggcatttaagagcgcctccttctcctatatcttggtttctatggaaaagagtaccaacctgccagatgcctttggcaagggaaaaggaagaaagaggtggactcctggggggacaaacatggggaggctggaccttgggtatttgaagggccacatgcaaatgtaatgcaaatgaagtggacccataagagagagggtgctgttgaagacttgctgtgcatgtgttggagtggcacccaaacatttcagcctccccttctttctatacctgaacaagtagttggagacaagtaattccagcaagactgtgccatagttctactacatgtggactagagaaaggagaggtttctcttttctcagaaaactcaggtcagtgatttactcaaagaattattaaggaaacttcttgacctgtcagctgatagggtacactgaaaagagaaatctttccattctatgcctgagcccctacctgaatcctttcccccaagaatttgggttttattaaaatgatttagtctatttatttatttatttatttatttatttatttatttatttttgagacggagtcttgctctgtcaccaggctggagtacagcggcgtgatctcagctcactgcaacctccgcctcccaggttcaagcaattctcctgcctcagcctcctgagtagctgggactacaggtgcgtgccaccatgcccagctaatttttgtatttttagtagagacgaggtttcaccgttggccaggatgatctcaatcacttgacctcatgatctgcctgcctcggcctcccaaagtgctggaattacaggcatgagccaccacacctggcctagcctgctattttatgagcccctcttatcactctcactaccctctagaacagcaagcactgcgagaaagaacccagcccctgctccatgtcctgagtcaagaactggccgagctaagacaagaccaacacagctcttgccctagagctcacagcataaatggaggtgctgactcaatggtcacatggtccagtgagggtgacactggagctatgtataaggtataagggaggatatttgaatgaggccataaaggagtaaccatttaggtaccagcagaggggacagtggcagcagatgtctggatgtttcaatagaagagttgacccctgacttgagtattcaatgatgagtgtcagccaagcagaaacagaggattagtatttcagatgaagcagaaatatgagggaatgacagaacaggctgggcacatgatgggaatccccagaaaccagtctgcctaaggcatgagagagatgaaattagaaatgtcgctgcaagcttgctcacacagggccttttaacccaaggaaaatgatgtgattcttgggacagtaaagagccactgacagttttagtagcagaagaacctggtcagaatacttcatttgtggttggatagggacacatctggaggccaggagaacaattaggaaggaactgttgggttccaggataaagatgttttgggtcaggagcaagagggtagctgttatgttgcagatgaggagatgggtgaagaaatgtgagaaagaaaagagggggatcagtgattgctttggtatggagctgaagatgagaggaagttgatggtgacttccagatttctaacttgggagaaaggaagggacatgggttcaggcaaagaaggaaaaaatcaagaaatcatcattatagtgtcaagtattccttctgccactccttctcttcctcaatctctgtctccctccacaccagtctcttcgcagggctccagcctgtgtgaggggctctgaatgctggtgcttgcataactgatgaggatgagttaaaggcagcttctagctgagatagctccagctgtggccacagagactaataggattgcccagaagggagaagctccagtgaatggaggaaattctgcatgcagtctctctgactttcagaatcttctggtccagaagtccttctgtcaggtggccttggcatgtgaccagccaaccaagagcacagagatcccaaggtttccagaaatcacaagaaacatccaagaaacaattctagagaagtctgtggattactgttctagcagtcaggtccagaagttggctacaagagacgagaattggaagagggaaaattcctcaccatcaagccaacgtcataatcctgaggacatgagcacagcaaggaatgacaccttcctctaggatcacttaaaggatctcagtgtcactgagctgaccacagtgtccttgggtggaaagaatggatgttgtgtagcactttggagtcagcagtttttatacatatgtgtatatatatatatatatatatatatatatatattttttttttttttttgagatggagttacctaggctggaggtgcaatggtgtgatctcagctcactgcaacctccactcccaggttcaagtgattctcctgcctcagcctcctgagtagctgggattacaggtgcctgcccctacacccagctaattttttgtatttttagtacagacggggtttcactatattggccaggatggtcttgaactcctgacctcaggtgatccgcctgctttggcctcccatagtgctgggattacaggtgtgagccactgtgccccctcagcagtatatattttttaaatctcatttcagactagctctgtgactttaagcaagttgcttttcctttctaggactaattgtttttacatctgcaaactggtgatgatgatctctatttcacagagcaaagggtaggtgaaatgacaatacaaggtctggtcaatattagatgcttagtaattattcattcaatcattcatgcataacatacttattgatttcttctacatgccagacactgtgcttggtgcttgggaacaaaacagagaaatattttcacctaagtagagctttattctaacatctatatgtaggggaggacggaagaaagacaacattcaataaggcatagtatgtaaattatttagtttgttagaaaatagtaactgctataaagtaaaggaaaagtcaagcaaggtaggggaaagggcagcaggagtgaccttgaacaagtcactttatttgcctgaaggttttacttcacgtgtaagtcaaacacaacaatacctacctcacaaggctattgtgcagaataagtgagtgcaagtcacctaaaattgtacctaggcctttatagatgctcaatagtaatagttatatcatcgtcaccattatcatcatgaggttgcaataataattgggcaaatcagaactcatttagaaggggccatttgagcaaaactggaaaatgatgagggagccatggggtgtacggtgtgcatcccaggcatgggaccactcaatgtcaaggccctaagacaggagcagggatttcaggaaagctgtgccacctgactccaccggggagatcagaaggggctcagaaaagcatcccctctgaaagaagctgagaaaggggaagaagcagttggaggttgggtggccccaagagaaaaagaactttggagaactaggctgttgctgaagcaacaaaaatagaaacatggaaatttctcccagctgctgtgaactgaccctggaacttagagccaaactggtggtcataaagtcagcttcaagtttgtgtgcctgggtttctgcatccttcgtgaccatgtgcatctttgtgtacaactgcatctatttgttatattttgtgtttgtgggaataggactgtgtctctgacacatgcgtgtgtgtgtgtatggtaatttggaacgagaaaattctcctctttctaaagcgatgtacatacaatagaggaagtagagacagagtcatcatgcttcatttcatatccatacttgactttcaacattgaagttacttacctttgagggccttaagctttatcccaccatcctctcacaggtgcaatacttgtcaaatgtctaaatgcaccacagcctcaggcctgcccgaaatttagtcatatgagatgacatttatggggcattgaggataacgatatcacccattctctcaaacattgtattgttgtgtatctacagtgccagaccccagggttagattctgggaatataaaaacaaggggccattgaaggttataggctttggaaacacgttggagtttgagtttcagctaattcccgttactgcttgtgtgaccgtgagcaagtcaccttatttttttaagggttttgcttcatctgcaaatcatatacagcaatacccacctcccatgggctattgtggagaataaacgagtacaaatcacctgcaaggtaactaaaccctgatagatgctcaagagtaatactgaagatcatcatggtcatcaccatttccatcactactgaccaaagtttctgccctcacatggcatgcatattggccgaaattacaattccactgccttggtctctgatcctagatctttccatggcttgttatctagcttcgtttaggctattattcataaaaccttcttcagaaaagtttccctgaccatccacccgcttttatttcttcactgcacaaatcgtttcctgtaattctgttatatgtattgtttttgcttacctgtttatttgtctccttcagtcaagtatgcttcatggaagaacagtgaccttatctctctagtttgctctagaatcagatgtgaactttatcttcagtatctaggacagtatctggtacaagaaggtgttcaatcggcatgtgttgaatgaatgagtctatgaatgaattagttaacctgatttgtgccattacagagccccagaaaaaaatgcaactaactctgctgaaaccaaagtattcctgtagaaagctttacagagcagagagcatttgatcagggagactggcaagggttctccggcaaatgcatgaaggggcatgatcatagctactaattgtgactgtatcttgtgaaacaaaccaagatcatcaatcgtgttccccgtctccctggagaacactgctgaaccttaacacatgccctgggagtgtgtggaaaagaagaaaaaccccaaatttctgactatgcataatccccttcagtcttccagaagcataggtccaaacttcatttgcatataaatggtcataattttttaatcatagataaattccattctgtttgcttgtccttttgccttccttgatagagaaacaagagtgacttatgattcatgaggaacagcaattaaaacacatatacatacaacacttccttacttcttgcatctcttttcactccttctccctccctgagtgtcagaaaatgccatcttgattgagaggtagtggttacacagtggattcccatggtttctttccaaatcctaggttcttcactcactttctatgcaattgcggacaagtcacttcacctttctaaaccccagcctcatcattcataatgagtaaaacataaaatcatgaaggttttttgcataggctaaaagaactggtgcacctaaaatactaacataaagcaagttctcaaaatgaaagttattatcattttattagtatcatcatattgtatgaaaatacatagagatgactcatttcaaatcagcaagagaaacccaaggtcttactctcagcagagaagagagagaaataaagctactatataggaatgttgatacagattatacctagatggtgatcatattgagaaactctgtatttcatctcagagagatcttaaattggaaaatagtataggtaccactcaagagaagatctggtccctgaaccttactaatatctgacattaggaagtagaccagcacgacaaaaatcagtcatcatcggacagagatctatttgatacttattttaaagacaactgtgttggtttctgtttcaagccctttactcttgttctgagatcatctgtgggagagaaagggcaaagtgcaagtgggggtggaagtgacacgtatcaggtcctcctgcaggtgttttcttgctttatctcatccgattttcacactgccctctgagacaagatttattatcccaatttgcagatgaggaatttgaggcttaacagggttaagtaatttgctcacatctgctgaaggaaagcctagacttgcagtcaggcatccagaatactttcatttataacacacatcctgttttacatggatattgaagatgtgggattattttttagccccagtttgtggacatctcttgccagagttattttcctaagaacctagaatcatttgtttgactgtatatcaggcttctgtggatgcaaagcccactagcaccatgcactcaacatttccaaaactaaacccaacatctgcccactccctcatttccacgatctctcttcccagagatctactccttttacacttttttccaaataattgtctttccccatgcatcactctagactgcttcttcaactcacctcccatcatcacataagtcagtaagtcttatctaatattcctttgaagatatgtcaagtccaccccaccagctccagctccagcttcactattaagtcaatttatatctcacttgaagcaggtagctgtagcctcctctctggtgtccttgtcctggtatttatcactctagcccatccttttggttcggccaagtttattgtcttaaaaacaaatgtaatcattgtgccactcctctgctgcttcaaaacctttgaggactcccttctgtctacatgttgaagatcaaacaccttagcaagtcacctgcaatataactcaacattatgcttttgtctcatctcttaccagcccccatggaaatgcctaattattcctctgaaatgcattgcatgtttattctcttgtatttttcccattttaaggaaaatcctactctgatttcttgtctgttaacaactacttaatctccaaagcctacagtgaatgtcctgtcaatctcaccaaacttccccagacaaactcagctccctcccttgtcagtacttcatgcacactgctatcattggccctaccctgtgatcatttttacacacacctgcctccctcagtatagcaggagcttctcagagataaatatttttttttcacatttttcttcgtctccttagtatctagcctgagaagtttccgacagtgagaattataatgcaggtatcattttgcatgttaacactaacatatcataaacatgttcccaccgagctactcagtcttcctaattatccttttaattgctacataatatttcttcctgtttatgttctataattacctaaacattcaattcaagtcattaaattcaacaaaaatttctaagtacttaatatgcggcaggtaccatgctagatgctggagacaccaagaggaggaagacatgacctcttccctgcaaagactgtgcattccagtgatcatgtgataagggctatgatagagatatatcaatgaatggattgggaacactgggtagggggagttttatttttcctgaagaagttgaagaacataaatttataggtgatattttctttgagttttaaaagttgaatacaaacctaagagaactggtaagaaagcaaagagggagggtgagagaaaagataaattactaagacctcacagtttttaaggggtcagagctaggatttcaatacaaacggtttgattctaggaccccactgttatcccttatctgctggtaaattcctacccacccaacaatgctttgcttcaaccagctccacactctttctcagttgttatttatttatttatttatttattttgctacagagtctcactctgttgcccaggctggagtgcagtggcgtgatctcagctcactccatctcccaggttccagcgattctcctgcttcagtctctcgagtagctggactacaggtgcacgctaccatgccaaactaatttttttgtgccaccacgccaaactaaatttttgcatttttagtagagacggggtttcaccatgttggccaggctgatctcgaactcctttcctcaggtgatccacccacctcggtctcccaaagtgttgggattacaggcgtgagccaccgtgcccagcctcagttctctttttattcagcccttatgtgttgcacagagctggggcgtgctagcaaattttctccaacccacattttcgttaagtttgataactagaattttgcaaagtattttttttgagttttacaaaatgagctcactaatatgatgcattctcatcctttgttcctgttttctataagaattgcaatgttaccaaggaaacaagattctagagcaaattcctgataaatgttaggttctcaaaagataaatgaaaaaatgatcaaccaatggctaaatgtatgagtttggctgtgtggaaagtagagaagaattagtagaatgtgaaaggctcatgtataatgtacttaaggcgtaatgtaggttacattatgacacttgcagaagtaaaacaataacaagaataacaaaaacaataataacaataaacagatacccaaattagtatcttggtaccttatcagaagcattcctgcttgtggaatcagaagatcaaagagtattaagagctatgatatcatccctaccctgtgacacactatttaatctaagaaaccatttaaaaaggggaaaacagcagatattatatggaccaccttctatattattaaaagtctggaaacaatctaaaatgtccaccaatagggagtggttaaataaattacaatatgtgaactggaaggagtattataaagtcattaaaatggtaattagaaagattatgtagccacatggaaaaacatttgctgtgtagtattaagggggtgggggaagctgaatacaaaattgaagctaggccatcaatgcagttatggaaaatgtatgcacatgaattaagacaccaggggaagaggcatgcatgtgaccagctgttctatactggcgtattttttctttgaaacatgtcctttaatttgctatgatgtgtattttctggcctagcgtatgctctccagcctctagggggagctcaaggcttcccctactcaagcctcttctatccaaccccgggaagatagaggaggtctccaggagcctgaggcatagtgaggtacccagggctgggcggccatgggggccttaaagctattatgaacagaacagaactgaagcaaattttccctcggccttttctcctgctcctttctgtgtatagtccttgacccctcttttagaatcagttgctttcttggcgttttcctcttcagtgcatgtacatatttctgttgctactgtccttgtccgctacattaagaaggatctagacagtctttcatctgggatgcaaagatcgctcatagcctacttttttaagaaaagcagaaattattctatatatttatttgcacaagcaaaataataataataaagatatatttttatggtctcataatttctaatttatttttttaaaaaggaagctacctaagtttccatcaatagcatactggttaaataagttaaggtacatctttgtaattaaatactaggaagatattttaaaaataaaacatgcatatggattgataaagttcttcaaaatatagtgttcagaagagagaaaggcaagatgcaaaataacctctctctctctctctgtgtgtgtgtgtgtgtgtgaataaattatccaaatgatcataatgagaaacatttgtctacatatgctagagtggataagtacttaatatgtaataatatgtgagaaaatgataaaaaacagttacctaagtggaataaaaactgagggaatgacacaaacttttgctttttaccccatattatattattttatttattttccctgtgtacatattagttttttattttttttaaaatgggattagggtaggacctaagggtaaggaggctgagataggtgactctgaatcagcagattctttatctcccaaatatatcacagtgagctgggctagaatatgtgtgtgtgtgtgtgtgtgtgtgtgtgtgtgtgtgtgtgtgtgggtgtgtatgtatatgaaatcagatagggatttgggcccaaactagaacatgcacctaccactactagcactattatttatactactactaataaagtaacagcaataaatttaaaacaataaatgtatttaatactgataataaattaatgtaaagcaaaagaaacaagtatttaaggttgaatacttaaactaaaatgtgtaaaatactttactgctttttttaattgtgaaaggagaaatttcacaaacaagtccattttaaccaagttgcattttgaccattacaaaggaaatggaaagtccatttaaagtaggacagggctagtccctgcttgtggtttcatattggcttcctaataaactgtgacccattacaaatgagattgagctggctttgtgctttgaaattttttttctcaaatgtctggtctccttagatttttgagccctgttttgcttttgctgtccatgaggttttgaagttcattgattttgctgttttaaaatattgcttctgaatgggggtgcttggggagtgaggactgactatggaagccaaaggcagagagatgagtgcagagacatttacagtcaaggccagagtcctgatgtggccttgccctaaagctgtgcccagcctaatctcttttccatgtgtagcctcactggggaactgtagcatctcaggctttctgaggaagcagacactacaatgagaacccaaatcctattcttccagcagagctcaatcattagaagaaaatggaatgtggaaagcatgtcacatacctaacagggatgctttgcttaggcagccacagccaaaagagtcacatcttcacatcagtttctctcctgcatgtgtggcccaggagttgctactcaataccacccctggagaagagcatggcatggaaccagagctaatctagggctttcatttctttattgcctgcagattccttccctacccaggcctgagacagagtctgtagggatggaatacagatgtgagggcaagggctcccatatcctggtatacaaagctcagcctgatggtctacataccattactactcagtggttcccagggctccctccatagatgccctgacaaatggtttagtgtagagtgatgaatggtgacattcctgtccactgggttggtgtttgaatctctttggtcaaaaacaaagttggttctagccatataccagaagtcttcatccttcaagatttcttatttggaatttagaccatctcttgtcataaaatttacactattacaaaagaggggttagaaccacagtacaacccagaaaagcagtttgagttaccatattttataaatgcatagctaggcataaactgcaagcctgcaatcaaacagccagcttcagaagctctaataatccctgtggtctagaacaaaatattgaattttaatgttccttctgcaaaaatggggttagtaacatcaaccctctgaaaccactgaggcaattaaatcagtggatgtacgcgaaagtgcttggcctagtgctgggggattgtatttgaagtatacttccctgttgcttccaaaaattcctaatatactgaaatgtcatacatacgtttaactctagctgcttcttaagtcaccaacaaaaagacagtgttaagaacaactttttgtgcttgaaccaatttgccataagtaacatcttgcaagcccccagtgccaactgacttatcactaagctcatcccagatgagactttgcaaatctctatttataaaatgaataccttgctgctaacttatattgggagggaatttcacttgccttcaaataaatatgctgtcagtaattgctgtatttccatttccatcattctgcaagtctctagccaaaaggtcacatgctaacttggtacgtatgtatatatgttgggtagaatacttgctccagatgatactagcactggatcttggggcatttatccgatgtctctgagcctcaattttcttacatgaagaataacagttactatatttactgcaaagttctgttgaaagattaaatcatatgatgcatatacacgcctgggccatatggcaattattactgttgttcttgttatctacgacttcatgagactttattttcagcatcatgaaagatgtgactgactcctacttctgtttgatcattctcctttcccatccataccaaaatgaatagaataataaaattacgaacatttaaggtagatctttaaaccagtgcaatatccaacacagagcattgcatgtagtagaattaatgaacatttgatgacaagttgagtaaataaaacagtccatacacccctcagggttttcagtcttttctagaacatcattaacaagcagtcttcagacctatgtctgaatatccccagcctccagaaacttaaaactacttcaattgcatttatagtgggtttaccaaatgtgtgacttgtgaagccatcttctaaccctacacctacggcagtttacacgcattgataagggcaccaaaacaggatcacagaatccttagctccagctagattaccaaaaaaaaatcagagtactcttcatattagagaagtctgtctttcagtgagtcatcatctatttctttctacttcttttcttgtggccctaaaagccagacagaaatagtctgattgttctcctgcatgaggttgcttcagagagctgcaggcagcttctcagtgtttcagatccaccttcagcaggaaatattcttctgcaaccaccacacacatattccagagatgtgaataagaaataggggagttcttcacaatttgttcatgaagagggaaaaggagaggcctcttggtctctgagctattattaaaataaatatcattggctaaaaggccagaaaaagtttcgggaccacacaggcaactgacacttttccaactctaccatatcatcactaattggatatgctaacactttctgtagcatttcataaaaaatgtttcaagaccaagtgataagatgtctaaacaagcttgtctttggatgcttgctctggttagttctgaggaaatacctacaacaaaatagcaaaggatttttctctcctctagtcccaggtgggtaattttctctccccaccccttctctcagtgtgtgtgtgtgtgtgtgtgtgtgtgtgtgtgtgtgtgtgtctccctgcccctcaatgggaacacagtcagattttgctatacttcagaatcatgaaacctcttgaaatagccatagttcagggctgaagtgtcaaatccagagagcttcacttgaattttccttggattgaacacttccccagagagatacaaaattacaaagatcatgttttgtggatttacttcaggttcagtcagaatgtgttgtaaaaggttaaacttattttttaatagcaacagtacccatctttcagagtccagagacaccctctatttctgcctcaagatttgccttcttgaggcagaaatagagggtgtctctggacttctgaaagatagatactattgctatctgtaggatcatattttcagaaagaagtcatattggctcaaatttgcaaaaacacaataggcattttaatgaaattgctgaagaaaaaataaaaggtgcctacatgttttgtctacatcaaattatgtgctctgctctggaaaactcaggtttcttgcctataaaagagaaaccgtctattgcatttattgtcccatcaacctcatcttacctatctaaggagataaacagccaatgcttacaccttccatagctactcaaagcacttggccttgaaaagttgctgtattcatttcctgtttctgctcctacaaattaatgcaaacttcatggcttaaagcaacataacttgattattttactgctctggaggtcagaagcctgaaatggatctcacatggctaacaccacggtgtcagtagtgctgcatttcttctagaagttttaagggagaattgagtttgttgcctattccagcatctagagatctcctatattccttggcttgagacccctttcttcatcttcaaagccaacagaacagcatctccaggtgctgctgtgtaacctccttcttccacttataaggacccttgagaatatgttggacccactgtgataatccagggaaatctttcatctcaagattcttaatcacctctgcaatgtctctttgaccatgtaagataatatactcagatatattttggggacgggttttggggactgagacatggacaacattgaaggacagcattgctacaaatgctaacgtaagatcatgggctggacctagatttagaaaataaggcaggcagatgaaggagagagagcctttggcactggtgaagaacttgccttttgcctggctccttattttgtcatcatagagtccaagtaaagtggggagaggagtcccatgtctaagatatggaaactgaaattgagagagtttgcatggtatttccgagactcacagttattccaaggagatcaaaatcgaagctctttccatagcactatgcccctggctacaccacaaatattacatggcagatgtgtttagcaaggttttatgatgcagagccagggctctgcacaaatattaacttacagttggtgacttctcacagctaaaggttattcctcaaaggtgaaacttacttcatgaaatagcttttttctttagtgggaagtaagcaaaaacatttttgtatttttggctgagccaaaagaaatgctgtttcgaaagagtaagtagttttcacctgtgcacactatattacatttcagtactttagaggtggtttttaaggaatatccaaaaaaatcaaaaggtaaaacgttttctatatggaaaattattttaaatcttttaaataagaggttagtcaggggtgagagaaggagtgtagagttaaataactggtatcctattccccgtgccttgtgtttctgagccaaattgtattgagttttaaaagaaagagtcttggcatttccacaaaatttgggagaagggaaaaacatctcatagaaatgctgctagaataaatcatacttggagacttctggccagagagagcagccttctccatccaccccaaattaggctaagaggttttctttgaaataaaatggacctttgaaattctgaattattagagtaactcaaactacatatttagaattctgagtaaggccaacaatcatttcaggcttttttttttttcatttttctgttatacaatatggtcttctgcatcattctgggaagaggcgtggtagatgacattttataaaaacttattttgctttaaaagctttacattttgtttcaatgccaaattcaaatttgagcatctgagaaaagcatctcacttctgaaagttattgatgattttacaaataagtcaatatttcactgatttcaataataaggctgaaagtttgattaccacctggcccatttgctacacaacattcagcttattcaaaggccaaatacaaatctcattaataaggaagaatgcatattttaggtgaactattttaggtagaataaacttacgaaagcgttagaaagattaaacctgaggagcttatgatcacaatctataatgggaaggaagaaagagaaattaacattttaaaagtatcttctaatttctcttattatttctgtgatccttacaataatgctttgagatagataaaaataaccctttacctaaagaaagtgaggctaagaaagcttaagtgacttttccaaagacacttttgtaaggagatggtcaactttagaagacctcagcttccaaaaatatcaagagatatttttcactgcccctagcacaaatatattcactctaccctcatcagagatgtgaggttaaaatccatgtaagtacaaaagccttttatcagtttctttacttgttacattggaatattccatttgaatcaggtatgtttccaggctggacgtgaagtgatgtgaaaatacagtgatccgcaggtcacctatgcaagggttcaccactcagctggtagttaaaatgctgtcactctcaaatcttgtttggctttcccacatgtacccatggtttctccaacactctcagatgttccatccctagcatttgaattaatatgttcaaattgattggccatatgtaatgatcaatttagttaatgtcgagaacaccaactaagagattatttctatctggtgccaggtccacctttgtgcatgctgatagaaacaaggaaggtccttctgtagagagaaagtagatcccagaatcagaaaccaggaatgcacattcctacattccttatccttagagatcaatgctatctcttatcatatacatattaaactacaatgcattagtattaggttattatgcataaataaactatatatttttaaattaattacactttttaaaatctctttaagccatattatacatatagacagtgtattaatttgtttgggctgccataacaaaataccagactaagtggcttaaacaataactttttttttttttttaacaattttgggggataaaagtccaagatcaagttaccctcaaggctgacttcttgtgaggccactgtttctggcttataggcaaccatttcacctctgtgtccccacatggcttgtcctctctgcatgtgaagagagagagagagagatctttggtatttcttcctcttcttacaaagctaccagtcctattgggttagggctccacctttatgatttaatttaaccttaattacgtccttaaagaccttaccttcagtcacattgagggttaggacttcaacatacaaattgacaaatttctgggctggcggggggaacaattcgatccatgatagatagatagatagatagatagatagatagatagatagatagatagatagatagatacatagatacatagataactaatccttatttggctagctaggatggatgtcctcctacaaaatttgctccatgacattaactctgttgcctggacattttactttaaagggtacgtgagatgtgactaataacccctatttcttggagttgttatgaagataaataaatgtatttaaattacttttttctggctgattgctactaataattatgattcaggtaaagtatcacctcttccaataaatgtatcttggttcttgcccctgctaaactggaaaaagcaccttttcttgtcttttttattttttttgagacagagtctcactctgtcacccaggctggagtgcagtggtacagtgatgctgttttggcttacttcagcctccacctcccgtgttcaagcaactgtcctgcctcagcctcccgagtagctgggattacagccacgtgccaccatgcccagctacaaagcaccttttctgtgaacccttcctcaatgtttacactacatcatacatcaattatatcattaaactataagctctttgaaagcaggaatagaatgtaattaatctccagctcttcagcaatcgttacaatctctagcacaccatccatattgaatgaataaatgcaaaatacctagtactgtacctagaatgtaatattaatgcaattttatgttcagaaagcactaaaaattcagtaagcattaactactaaaaatattttagttacttaaagttatagaaggtttaaaaatgattaaaacagtgggtgtgatgaatcttatgtttcacttttataatgacttgttatttttgaaattcacagcttggatagtaaaagaaatgagagagtttcagttccagtactttccaggctctaccacaacattgcctaatgcagaattcatttcagacaattctccttttcgagagttttcttgaccacccccccccccaaaaaaagtaaaggttattttttcctattgtcactgcttactagtcttgaaacattaaacattatttttggaaatttaaatgggaggttttggcccacagaggcaatgtccgctgtccagcaggactggctccaggaggtgaggcccatggctgtgtttaaatcagcaatccaagcccagaaatattctcagcaaaggggcagctctgggcataccctcttaacaatctgtgtcttttcatggaaaaatcccctttggatcttatgatatatttattgactttctttccatgtgaagggattccaaatcttccaaaggaatctgatggcctcaaaggatatattcctacctgattttccagaaagttccatagactcactcttaatagatatacccagggagattaggtaactgacaggttccgaatgtagttaagttagcatttttcccagttacaagtctaggatcccatattcagaaaagtttgtaccatttagcaatgagaaaatacacctgctaggttcactgtggaattctacagctttaaagcgcagaaggcggagattcccaatctgggctctaaattggtgtcatccagagagatgtgaaaaatattgataccactccagagattcttatttaattagtctagcagcctgggtatcaagactttaacagctttccaggtgtttctaatctgcagcctagcctaataagctctgctctgaggtctggaactgtgtttttcatccctggataaacactggaatctggggaacatcccaattctcatcccttccatctaagtcagtgattcttatactttatgtcagaatcatctggagggattcttaaatacagattgtgggccccaaccccagagtttgtaatttggtatatatggggtagggcctgggaatttgcattttaacaagtttgcttatggatctgtggttacaggtcctaggacccacttccagaaccactgccaaagatatgatgtatttggttcagggaactttgtcttcctagactgaaaaatatccgaaatctatacctaagtgctattaccaattactcaccctggcattgcaatggagattcgccatgactccagtttgagtagtgccttaaatccctcccccagggctacccagggtagtgtcgtatagtggacagaacacaggacaaacttgctttccactcctgtctgtgccccttagtagcacataactgtaagcacgttgttagccttgggtgatcaatttaccctggtttatgtagacctttaccagtttaagcactgaaagtctcacatccttggaaaccccttagttcagggaaaacctaaaaggttagtcattctttggtgtttccattgttgtttaaccagtggtaagaaaagccaagttgactttgaagagtcccttcaagcatttgagatagtacatgtaaaccaccttgtatagagcagttgcttcataaaaaataatcgtgattatgtctatgacatattttaagatggattgtgtagggaagggaatgacatgtttaatcaccagtatacatttgtagtgaagatcatgcaaagcctttggtttggctaatgcttttagagcagtgggtctcaactttggctgcacatttagatcacctggggagatttcagacaacctcctccaaatacccaaaccacagcccagatgattaaatcagaatatttggtgttgtaactcagacatgagtatttttatgagctccctaggtgatttcaacttgcagccaaagttgagaccttctcaaggtgtggtccctgactggcagcttcaacatgacctgggaacttgctagacatgcacattttcaacactctccccctccctactagtataattgagatctttggggctgaggcccagaaatcagtgtttatcaagttctcccttgcacactacagatcacactttgagtaacactgaaatggcactttctgttgctctactaatgtgcttatatttattattggcaaatgtcctctctttctagcagcactagataaaccttttttatagaattattttaatatactatttggttctattttcaaaatttttacttagaatttttgtatcaatatttaaaagttgttttgacttctagttttgattttgtgcaatctttcccacatcttaatgtctatgatatcctaacttgataaattaattggaaagcttttcttcttattttatgttttgaaccagtttgtataaattaaaattatctgttcctcaaaaatttgtaattcactggtgaaaacacacttggctgtgtcaccgttgttggaagcagatttcttttcacagtttttttgtccataaacattatttctaatgttatttttggccacctatattacctagaagaccatccaccttgaaatctttttttcaaactgttggcttaggaaataatactatgttttcttaaattttttttttaattatttcaatatgtgtgtctatgtctttttccaaacactagaactgaatgtttagtgcatgaatttaagttatgtactaaattttttcgtttatatttaaatacttgaatatatgaatattcctacgagaatagctatggctgacatccataaattttcatgttatatcattatgaatttttgctttttagaaggtgctgtgatagataagcaagatctaaaagttctttgagcaatggaaaataagacatttctttgttttcactgcacaggagatttacatatgaatatacttcatgcttataagtgaatatatgtatatcgacctgcaagaaatcctctttccttgtctattctctaatttttaatgtattttattagtagaaaaatgattagcaaaattcctaacctacaataaaaataaaagaatcctccttttttcaattaaaaaatttaaaacctttgttatttatgttgcagaaatatttgctttttaaattttaattcgcatatgtctgatatattgaaatcaaacatcttgttatttactattttagataaatttttttcaaaatttatgcatgctatttgtagaaaattttacaagttatattagtctgctttcatgctgcttataaagacataccaaagactggagtatttatttaaaaaaagagattttatggactcacagttccacatgccttgggaggcctcacaatcatggcagaaggcaaaggaggggcaaaatcacatcttacatggcatcaggcaagagagcgtgtgcagggaatctgccctttataaaatcatcagaacttgtgagacttactcattatcactaaaacagcatgggaaagacccacacccatgattcaattacttcccatggggtccctcccatgatatgtgggaattatgggagctacaattcacgatgaaatttgattggggacacagccaaaccatatcacaagtatttaaaacaattttttaaaaacaccacggtccccacccgttgataccactactatttgggataaactctacttattcttctgtaatctagttatctctatttgactaacagcgacccaagaaaaattcagaatattaagtaaatttcttatcacatatttttaatcacttcagtgcattttatattatggatgttgacattttaatcctgcacatataatatatattgtttttaatttttaaatattttaaataatgctgcaatgagtgttcttatgtattcatatctgtgtacacacattctcttagaaaaaaagtgtctaaaatggacaatcactgggttaatgaatacaaaacatactgataaattactgtactgaaatatctttattttagctatgcttcttttaaatagcaaagagttgcagttttatattgccccaggttgaaaaacagtaatttgctttgtatatatttttccaaagtacttttttccttttgttgttattggtttctgactttgtttttgttttagtgtttgcccattttgcattttgtttcctttcctttgtgattctgtattgtttgttaattagaccctagacctttttatcatctcataattcagaatatattttatttcaagtatttatacatttaaactgcagcactttgccagctcctagtccatacaaggaccaagacagctgctgccctagttctcaatctggccatgaacttcttgcatcacaatcattttggagcgattattaaaaattcaggttcctaagcccaaccatgaaaccagatgaatcatagacacctagagaatgtggcccaagaacctgcatttttgtaagtatcccaaataaatcttggacacatggaagttttagaatctctaatttcaatttttttttttctggcagaacagacaaagatcacaccgaggaattacagataaaccccattctaatggtaagtagcattttcagtggttctattgtgctccgattacttatctgaattaaaattagatggatacttgggggatggctaaatggaaactctgagcactgtttctttagtggcttttaaggatattctgtgtcttcttaatgaacctctgtgaatgacctcagtcctgaggagaattaggctatttcaaaccaaccactttccttacttttcccaaggactaagtaactattagagcagacattaaaccgtaaccaccaccagctatacccgatgactcaactcaggttataattaggggaaggaaacgccagtgggaggctggtggggctcagaggaaggcagtttgctggaatgaggaatgttccgggtcttcctgcaaaggacagctggcccttctcagcggtcagcactggtcagtgtccacaggcactgctgacatccttaagccacctgggcccttaagtgtccagaaatacctgagtcttagaaggacaaacagaaagacacccagatactacagaatatttttaagctggatgatcgagacttgtcctgtaggtagcatcaaaggggagaagtgatagacccaggatttctagtgtttgaggagattcaggaagaatgaatggtttttggagctaggagtagccctaggataagaagcccccaggtatagcaggaacaattatggagttaaaaattagaaagtgtctaatttctaagacatttcatgttaaataatattaacataacgttaactcatcagaggtgggaagattgggagtttggggtgggggatggtgcaaaagaaaagtcctggaaagtcctcagcaaaatgaaaggcttccatcatctaacctctgctcatttctccagctttaagtccctataagctctctccctatagactctccctataggctctctctctctagaatttttcttgctataggttctctctctagaaggtctctctctataaaaccttcccctatagggtcactccctgtagactgtctcccgataggatctctcgctatatattctctcgttatagactctctccctatagactgtcttcctagatatctctctataaagtctacccctatggagtctctccctgtagactgtctccctagaagctctctcactgtaggctttcttcctagagactctctccctcgaagttttctctctatagggtctctccccataggatctctgccacagccacacttccttaaagtccctgacaacacctgttccctccagcattatactctttgttgtactattccttcaacctaggctattttgtgtttacttaccattgtctctaccctgcttcgaagaccaactctactatgtatggaaggtgcatgaatggacacttccatctagtttggtgaatatcagactcattaacaaaaaagtacacaatgtctcatcattacatatatgtttttgagacccaacaaggattttagttcatatcaagccataaaatccagtttttccttcaatcaaagaggatttcctatcctcaaatactattctaggtttgaataaatttcccatcactttcaggggaatgcagtggaaatacattcccaatgtgagccaccttggacgctgtcatgaggaaagaggcctgtgccttttaagggaggagccaggatggactggggacagtgaacacacagagctgtctgcctggagttggggccaaagcacaggaccttcctttgtaaatgtgtctttatgaatttgtgtcaactgttccctgacccagaatcacccagttaaacaaaccagggattaccaaaaacctcacacaaaaccaaacctgccaggccctttataatccttaagacagtctctacctgtttacattcatttaggctctgataaaatggtactgaaaaagccttccttccaagactctcaggatgcagggattagctcagttttcccttcaaaatgacattttccaaaccatatgagcaaagtttccttttcagtggcccattgaattgcaaaagaaaccaaccaatggtccatgtcactcataagctattctaacctcaaatacttgccccagaaatcatggctggacaaatttgaaatacccaaacctggattaagcctgtaagcttcaattgacttcaattcaagcccagctccttagttttatcatggatgacattacatcactgcattgcaatgaaacatataatcagaaagccagactctactttcctctggggttttggaagagtaattcctttttaggggcaaaaatgtgagctgtgacgaccttctttatattgtaggtcaagtatcaaaccaagcattcatccttttaaagagaggttgccagggaatcaagtcaatgcctcacttgttgacttattctccaccacccaaataactgctcgggcagggtcactttccagaaattatcttggtgagcaaacccctttcttttcccattcaaccttattggaaagctcaggcatgaagagacagacattgagagatcaagtttcagggactgtcaaggtaaataaagcattggaggttgggaatataagaacccagtgcctgggtaacaaggggaatcagaaattaccttcaggacatgcaacctgggaacacagcacaagcctcagattagaatatggacccggagaaacttgtaagcacagtacaatagaactgaagttggaggacacaaagtgagaccgtaattggggaagaatcagatggtctaaggaatgaggtgaaccacaaacagaccctgggagatccaagcttttctggatgtgaatcagccaactccttccagaatcccagctcagggccaaagcaggagtgtgtgcctgggcaggtctgaggccacaggtttgagcatgtagacccatgcacaaggaagacaggactctagggcaggaagccaggctcccaatacaagctcaggcaacaactgctcccttcccaaaatgggcatcataaagccaggtgaaaacctgtcatcccaataatccttcatgattcgcaaggagagaaggtgtttctacaatttagtatgaaaagaatgttttaaaatatgcaaataattccactcacaaacagttaataatttataataatctttatttgctaataatttgaatattatgaactgcagcatactgcaaagcatactgatgctcttctctaagaactatagatgtattcctcttggagttgtattttattttacttcccagaaaaggagccactccattaaaggatgagaaaccggcagctccatgtcagtttttcctgtcaacaggagctagcagaggttttctcatttgtgaatctagtttagtttaggtcaataattagagacatatataatttaggccaggtactgtggagctgctagaaatgtaaggatgagctgacgcattctctggttggcaaatcatagccattggcttgggcaagtcattgttgaacatctgtggcctccattgtacctgccctccctttgagaaaaataggcatctttcctcacattgagacaggagcacattagcaagggaaaatgctgacatgtatttcctacatgccaggctctgtgctaagtgctgtacacatgttaccccacttcaccctcatccctgtgaagcaggttgccttctgtttaccatgtttttgtcactggtgcctaccagacagcctgatccatagaagagtcaagaactatttttgcaataataaatgaatgagtaaaatcatagcatgccaaacttttcctacatgaaattttcagtctccctctaacagtaaaatttaaatactgatttccctattcagaaatgttaggaccagccatggtggctcactcctgtaatcccagcactttgggaggctgaggctggagaatcacttgaagccaggtgttcaagaccagcctggacaacatagcaaaaacccatctctacaaaaaatacaaaatattagctgagtgtggtggcacgtgtttgtaatcccagctactcaggaggctgaggcacaagaatcgcttgaaccttggaggtggaagttgcagtgagcagagatcacatcactgcactccttcctgagcaacagaatgagactctgtctcaccaagaaaaaaaattattttgaaagaaattttagtttggagacagtgaaaatatccaccaaaattttatatacgtgtgtgtgtgtgtgtgtgtgtgtgtgtgtatgcactagacagtaggaacagaagtcctagtcagctttccctctgtcatcaggtaaagaaggcagtgtatgtgaaggattggaagtggaaaacattgtgttgccatctgtcctctctctccgtccaaatacaagctcatttgaactcattagacctaccattcaatccagcaataccattagtgggtatctacccaaaggaaaagaaagatacctgcacccctatgtttattacagcaatattcacaatagcaaagatatggcatcaacctaagtttccatcaatgaataaatgggtaaagaaaatgtggtagatatacatgatggaatactagtcaggcataaaaaagaataaaaatatgtcttctgcagcaacatggctggaattggagggtcattaccttaagtgaaacaaaccaggcctagaaagacagatattgcatgttctcactcataagcagttgctaaaaaaaaaaatgtgttttcatggatgcaaagagtggaatgataaataatggagactcagaagggtgaggaggtgggagggaggaggataggttaatgtagtacaatgtacattatttgggagatggatatcctaaaagccctgacttgaccactacacagtctatgcacgtaacaagatcgcacatgtaccccataaatttgtagaactaaaaaggaaaacaaaacgaaaacacataaagctcattctagtaactgctacctgtttggcactgttctaggaatttcacatactttcagaaaaactagtagttttgtcttccttatatatatcaggaaccagatagatctatgtttcctttttccttgagtccaaaaaaaccatttattccagctgccttatacattaaagaacttctttcgaaaacattggcaggatacatcagaaggggccagtcctcagcccatacaagagtgaaagatgatacatgcctacagcagtgcaccataggaaaatataattactacatgcagggcacagaaaataatagcgtacagtgtgcagatcaatcagtgaaatgaagaggtacctagaagtattgctaggctgtgattaggaatgcagaatttgggggtaacctttgatgaggtaagatcaagaggacatagagcatgtgattgcagctatgttttatgaaatgtaggaattatattttaccctagatctcaaaacatacataaatcaaccgcagggctttcttgaacaaggtagagcccacagcctctctatgttcccatcttccagctagcggatagcaatagctaagtttaagtaataggagtgttctagtagagtttcctggaagccaaacctggagaatatgcagtttatataatttttttaaatggatattcaaggaatctcttatttgaacagtttaatcaaatgtcttatcttccacagaaattgatgtttgtaattcttacacaccatcaagagaataactcatcaatgtgttggctgagtaattcaaattataatataattcacttatatgttaacaactgttagatgccaggcactgttctagatgctttgcatgcattggggtaagctaatgactctgaatttcttacatgttgagttcgaagtacctgcggatttccagataaagattaatttgctattttagcacacactaattgtgaacctaaaatgagccaggcactattctaggcactggagaaaaagaggtaaaaagaataaaaagagatggttcctgtactgtaaaaacatacagtctagtaggaaagagagacccaaaactaattgtaataacatggggtaagctacactataataataaaaatgacaatggtgataacaattataaatgatgtaatttatttagcacttactctaagatagacattttatgtgaatgagttcattaaatactgttaaaaactctgtgacgtccatattcatatttccaaatgtataaatggagaaactgaggcttagataaaataagcaacgccacaaaatccctactgatcagtaacggaacttggatccatttgaccccaaggcttgtgctccctattgccatcctatattaccccaccattcccacccccttttgattttccagagttatgaatgcagtacaattaaggtgcagaggatctgggagccagacgagtaggaatagaaaggcttcataggagggcaaaatctgaatcaagccttaaaaaaataacttggcatttgtgtttgctaagctgtgaaagatgggtacaggttgcaatgaaatagtacggtaaagatttgggatcaaaaaaaaaaagtctgcttcgtttaagaaacagggattagcgcagatggaatatagggtatgttgaaagaaatgagagagatgtgactagagaaacacatcagaaccatgtcaccattgtcgcagaggaccagctgcgttaaagacctgtgattttatttcatagagatgatccattggctcttttttttttctttctttcttttttctttttgagacggagtttcgctcttgtcgcccaggctagagtgcaatggcgcgatctcggctcactgcaacctccgcctcccgagttcaagtgattctcctgcctcagcctcccacgtagctgagattacaggcatgaaccaccaccacacccggctaattttgtatttttagtagagactgggtttctccctgttggttaggttggtctggaactccagacctcaggtgatcctcccgcctcctcctcccagagtgctgggattacaagcgtgagccaccgcgcctggccgaaccattggctctttctaagcagtggaataacaatggttcataacatttagaagatggggttatacactcaccagatctatttccctagagcctatttcagtatctgatacagggtagattttaataactgttgtcaactaataaatatatatttttaaatacattgtcagcaatgtggaagatacactgaagaaggaaaagactagtggcaagatataagccaggtggtaaaatctaaaagaaaagtcagtgatagaaaagaagtttgctgagaatgatggtttccagcttcatccatgtcccatgtatacatatgtaacaaaccagtacattgtgcacatgtagcctagaacttaaagtataataaataaatatgtgtgtgtgtgtatatatatatatacacacacacacacacaaagaagttgatatgggagagacatttgaggtagaattgacaggtcttggagacagcatgactgtgtggtctcagagagagacactagttgagaacaactcccaaaattcctatttgtgtgtgatcctccatgggggatacagaagggggagtctagtcggggattttgagttccagttgcctttggaacatgactgcacagatcgcggcctgaaaggaagtggcagagaagaaaaattcaaaatggctgccaatagtttgccctctggaggcctcagagttccgggggccatggatgcatggccacgcagggtgagcaattgtgatgagagaacagaaaggaaatccaaataagagaactcaaagcagagatgagctaaaaatcagcaacacgaaccatcacaagtgggtagttacgctcggcaggagatccaggcaaagcgagggcaaacttcttagccttttcctgtggaaaatttataaagctcagattggagaaaacgtactgatagttttgaagctggcattttaagttggaatgtcttctcaaagtagcacataacggcacaattcaataactctgaccattgtggaaaaatgccatgtgccaacagcgattttccataattttgttcagaaaatctgaaagaaatgcaaaaaatggatttgcagccctggcagcaggcagagaaacagtagcagagggctgcaggccagtaattgatgtttcaaatatcactgagtgctttgcctgtaatttcaggggagaatgataataattaaaagcacaaacttacaagtcatttctgaggaggaaaatgctgaatgcacttaaagtgaagggggtttgttgaaatgcttaagtttttccagcgagctttcagatatgcaatgattagttttatgttcacagagtgactttctcctcaaatgttccaaagtgccacaaaatggaatagattattaacccatgagattccctgggagccagtgatgaaactataaccatatgacattcccacatgttcagaccttacttgattgtaccggcctttgttacaaacagcacagtacactgtttaaaaggatgaaatgaaacctttcctccttctcccaactgacttggggctttactacgaggcagatttgagcttgagtctgcatccaccctttttagtgctgtgaccttaggcaggtcactctattcctctccacttccattttttcatctgaaaaatagatagaacaatagcacttaacatctcatagggtgaatattgaggattacctgagagtaaaacaatcaatataatttcccacttataatctacgctcaataaatattagctattattgatattattattactgctaaaatgacaaaggcacactatttttataattatttatttttgctgacagaatgtaaatttggccacagattgtctaaattttcctgatattttaaaacaaacaaacaaacaaaccagccagagattcaactgagcagcataaccctttcctgaaaggaatcccccatggttaaacaaattcagggactgagttttccatatcccagaccctattacccattgtattacaggccctggcatgcagtgagcactctataaatgtggagcacatatattgctgaatgggtaaacagttttatccctcctgagaagtaaggacctctggtccctcaccactttctgatgactaatattatgcttgtgcccacacaagttagctgtgacatctggatttttttcacgtgcaaactctctcctttccaagcactgaccaggagtgactttctgcagcttgggttgacagatgagataactagctttgtcttttcagacaaagctgtgggttgacagggatattgtaattaacaagtaaagtgaacacactaagcacatgctgcgattgtaatgcccaccattagcactgcactaaatagagtcgttttgtatttttcttcagtaccatccacctcttactggcctatcagagtgaattttgttctctggaccatgttgattcattcacttaggttttcacagatgtgaccttacctgttggctcatgattctgaatgtagactagtgaccagtgggagaggcaggacttttttacttttgtttttcctgctcaaaacaggatcttttatgtccccagaaagtaatttacacaagatagacctactatataaacagagagaaatgtaagttaggctggtggcttgtgtcagcctgaaaggtgatactgccttaaccagcatgacttggaggcagaacggggggagtcatgatgaagttgtgatgctgcttctcagctcctcctaaataatatgttggtaatgtggtcacacatggctttttgttcaagacacacctctacccaaatgcaagactaaagtctctcaaagaacctatggcattttgctaatcaaaaactctagatatggagttgggggaaaagggctgcattttatccctggaaactgcaacatgagtaactgaggttcactggaataaacagcacattcaaggaagttaaagacctgccaagaaacagtgaggcaagataagaaagaggtaccagacaatcttgttgatttcaatttgcaagcaataaccaatagattatttatttccagttgaattttccaagccaaattcagttacatcgtaatcataatttgtgtaaaaatgaaggttgactaaccacctacgatgagaagttaagaattaagaatggcaatgtatttatttggaaaaaataaaatacagagcagagctgcaagaaaactctcagaaaggtgggactccctggttggtctaccttggtgacttggtttaccccaggaacactcaaattagattcacattcctgggccaaggggtcaggtgtttccagttaagagtcaggatccttgaggtcttctgtagacatctcctttaaatggatgaccttaggagagggatttatccaaatctccatttgttaaagttatggggtttaaactactctcgactctgaaagacatatactaatggaaggaagggaataaagtacaacttagatagagttgcccaaacctggttgatatcagagtaacctgcacacattatttaaacagattatgagaactcactcaagaccaaatgggtacaaatctctgaaggaagggcttaggaatctgtatatttataaaagtaattctgacatgtggccagcctgctgtcagattggtatctgggaaaacattgattccctctggttctctctccaataaccaccaatcgattcctagaactatatgttagtttacatttccctgaatgttatataaatagaatcatatagcacatacattgtctagcttttttcacgatacatatttattttgacacctatctgtgttatatagaatgtattagtagttcattctttttattactaagtagtattccaccttatggattccagtttgtttatccacttatttcttgatgcacatattgttttttctcatatttaaactactacaaataaagcttctatgaatatttgcatacaagtctttgtataaacctatgctttcatttttcttggacaaataggagtggtatggcagaatcatgtagtggatgtatatttaacttaagaaccactgtgctattctccaaaatggttatactcgtctttatttcctctagcagtgtatgaaagttctagtccttccacgttatcaccagcacatatatagcagccttagaaacatcttacatggcaggatgaggagcaagtgagagacaagagagaagggttacacacttttaacaaccagatctcctaagaactcactcactgtcatgagaacagcaccaaggggatggtacaaaacccttcaggagaaatccaccaacatgatccaatcacctcccaccagacccctcctctgggggattacattcaaatgagatttgggtggggacacagattcaaaccatatcaggtttcatatataggtctataatcaattttgagggttttttttatatatggcatgaggtatgagtaaaatgttattgttttgtatataaacattcaatagttgcaatatcacttgctgaaaatactatcttatctccactaaattgcctttgcacattttccaaaagtaaattgtccatctttgtatggtctatttctggctctctaatcagtactattgatttatttatcagtctttacaccactgctacactgtgttgactattgtagcttcataatatatcttaaaagcatatggtattagtgcttcaactttattctttttctgagttgtcttgaatattttaggtgcttagcacctctgaatgaattttagaatcagtttgtcaatttttacaaaatgatccttcttgggattttattaggattccataaaatctattgctcaatttgggaagaatcaacatctcaacagtattgagacttctgacatatgaacacaatatgttactattttttgtcagatttagcccatgtatcttatatgttgaaggtgactattgatattattttatttatttatttctaattgtttctagtatatagacatacaattgattctgacattgttcttgtttcctacaatcttgctgaactaatttattggttcaagttactttctgtagataggattttcaacataatcatggtaattgtgaataaaaacaattttacttattcttttcaaatgactctgtttggaatttttaaatgtatcttcatgagggatattggtctgcagtttccacctcttgtactgtagttttcaagtatcagagtcacgctgcttcatagcataatttgggaaatgttctctccctttaaatgtgatgaaaaagtttgcatagaattggtattgtttctttctcaaatatttggcagaattcaccagtaataccattgtggtctagagttttctttgtgaggattttaactacaatttaaatactttactaactatagggataatttgggttatctatttatgaatgactttaataatatgtgttcttcaaagaatttctacatttattgtaatttttcaaatttactagcagaggattgttcacaatatttccttatcatccttttaatatcagtagaatcttcagcaagttcatctttcttattttttatattggcaatgaaagtcttcaatattttcttctggttactctggctagaattttataaattttactgatcatatctaagaatcaaggtttgtttccaatgatatttttctattgtttttctatgctctattttgttaatttctgctatcatatttatgcgtttacttgtttatttattcatctatttattctacatttaaatcttcatttgccattttcttaggttgaaagctggagtattgatttgatatctttcttcttttctaatataggcatttaattctattaattccccccaggtatttccgttgtggcattccaaaaaattgtgatatgttgtgttttcattttcattaagtttgaaacacaatttaatttccttttgatttcttctgtcagcttttttagaagtgtgtaattttatctacaaatatttggagattctttaaaaatccttctgttaccgattttagtttacttccattgtgttctgagaacacactttttatgacctaaatcctttaactgtattaagacttgttttggcataggatatgttctatcttgttgcatattctgaatgcccttaaaaagaatgtgcattatgctactgttgagtagagtgctctataaatatctattaggtcaagtggcttgatagtgttgttgaagtcttctacatacttactaatttcctatctattttattatatcaatttctgagagagtagtattaaaatccccaactatcaatgtcaacttacgaatctctcatttatgtccttgattagtttttatttcatgtgttttgaagctatgtttaagggcataaacatttagaatcatattctgttgataattcagccactatattgttataaaatgaacagtttgtttctgttaatattcttagttctgaaatctactttgatacaaatacagccattccaggtttctttttattagtgttaacatgttaacactaataaataataacacgttatatctcattccatcctttttattttaaatatttgtctttatatttaaagtatatttctttgtaagtagattacagtgggttctttttgtctatccaatgtgaaaactaccttttaattgggatatttaaacgatttaaatttaatttgattattaatatgactaggttcaaaactattgttgttttatagttgtttcatatcctctttcttttgtccactttttctactttctttgaatgaattgaatgttttttattattttcttttctctcttttattggattaccattagctacaactttattattacttttgctatttagtggtttcattagagattatggtatacatcttttaacatatcacagtctactttcaagtgatatcatatcactgcatgtatgatatgagtcttataagagtacatctaaatttctcttctcatgttctctagaatattgctataacacactttacatctacatatgtgtgtgtgtgtgtgtatatatatatatatatatatatatatatatatacacaccccaaatacaatctttttatttttgtttaaacaatcaattatcttttaatagttcaagttttaagaaaaaaactctatctatctatacaagttatatttgggtctttttaaatatcttccatatctcctcttaggtttttgaacatctggaatacagttatagtaactgttttgctgccatttctctgctaatactagcattttgtcagttctgggttggtttctaataagtttattttctcattttgttcttgctctttgaatgcttgataatttttgaatgaatgccaggaattgtgtgttttatgttgctgaatgctagatgttttttgtattctcataaatgttcttgaactttgctctggggtgctttaagttacttggaaattatttaatctttgagggtatggtttttaatatatattatatgggaccacagcagtgttcactgtagtgataactactctccaccactgagacaagacatttctgtggactctgccaaatgcctcatgaatcttgaggtttctggtcgggctgctaagaatagtcaacactatcagctttctaatccctttcggtggttcttttcctgacctcaggtagtttacacacacacacacacattcatctgtactcagtttaatatctgagggatgcctttttagatctctggagtgcttactctcttaacagctctttcttctctgatattctagccctcttgacctccctggattctctgctccatgtcctcttctcagggagcccaccaccctctgtctgggttcttccttcttatgtatggccttggatatctctgatggcagtaagctgaaacaatttgaaggatctcatccctcagagatcactgcccttcactgttggatgtccagtgtcttgcaaattattggattatataatctatatagtttttaaaatgtatttactattgactgtttcaggtaaaagaataaatccagtccctgttactccatcttagctgaacgtgaaaatataaagaattatttttatccccatttcacagagaagactaaagaccaaagtagactggttttccccaaggccacatgttgccaggtgtggtggctcacgcctgtaatctcagcactctgggaggctgaggcagggagatcacctgaggtcaggagtttgagaccagcctggccaacatggtgaaaccccgtctctactaaaaataaaaaaattagctgagtaatatggcaggcacctgtaaccccaggtacttagctggctgaggcaggaaaattgcttgaacccaggaggtggaggttgcagtgagcagagatcacaccactgtgctccagcctggatgacagaaggagactctgtctcaaaaaaaaaaaaaaaaaaaaaaaaaaaaagaaaagaaactcacaggagtgcactactgtatacatgtttgtttctatttttgtccttctagacattaaaaagtcagaattttccttctctagtttcttgggactttgctctggatgtacaaattaggcaactctttaggaagctaatggtccatctggtctccatttagaaagttgatgtggagtgtttctttttttgccagtcaagtttctagaactacccatcttaaaaatctttctttactggtcatttttcatagtggccacccaatttgtttctctaaatgagattcccatatttgtgctttatatctgcctatcctcattcaacaattttatagttcaaactcatctttttatttacccatatccctggaactacacaaactgacttctgccagcatactttcatatgagtcacctcctagttgctcactatcaatgttaacatacgaaaccggagttacattatcattttccccactctagtcacattgtgttacagtcaaattcacatgtaattttatttttgggtttccattgcatctgtctctggccttgaccttagaaggaaaaataattcttgatatttcatgtgtatttggtgcctgctgtgtcttttaataaaatttggagaagagtgaggagtagagattaaataaaggcagagacatcttctttggacgagagtgttcaatgttaagaaaaagacaaaacaaaacaaaacaaaaaaaacaaaaaacaagatacaagatccaagcatcaggggttaaagatttctacagtgaacaaaggcacctttggtaaatgatctcatttagcaaccatgactagggaatcacaccttgacttcacacttctctccttgcattcactgggacactgggccatgtatttattatgtccccagagaacaaagacttacatacaaaactgcaaacaactcagcaaagttgctaaaaataattatatttcagtagatgattctaagaaaggagggagaaaaatgtacttagcaaaaccagaaatctccagtagacactggagtagaactgaacaaaatcttatataaaaatagcatttgggtcccatctgaatttagtgataaggactgtaacaatacaatacaaatgtacctcgtgcagcatttgtcatctgactctggctctcggacactttatagcattagataatgcagttacatgggagatctaatagcagaggaacaggaaaattaaaagatttaaagtcaggtaggcatagtagtatgtcaaataaatttacaagagaattggtacactgacaaggcccagatgaatcaaaaattcatgtaagaaagagattattttaggatgacaagagctaggtccaaagagtgtcagaaagaagcaggaacaggaagaaagatgcagataccacacctatgcgtggaccattctctaatcacttcatgcaccccatcacattttgtctctacagatctctctgatacacacatcatcatcttaaccttacacaggcaaaaaaaattgatggtcagggagtgaatgcaaatttcccaaaagtcaaataacaagtgccagaggcaggatgcaagccaaatcttctaactgatggttctcaaattttagtgctcatgcggacacgtgcatgtacacacagacagaaacacacatctcctggggaggttcttaaaaactgcacatttccaggcacccctccccaaatattttgactcagtggatctgggataggagtctgtaagaggatcaagggatctgagggctgatgagggaaaaaatatgaccatgagaggcagtaacatacaagtttttttggtggcacttgcccaggatcacatgacaggggaagtgcctcatagcactagactatcagaggcttatagggaaggggccatcacccagaagagaaggagggacagggaactacctgaagaggggatatcagagaggggcttacgtgtctaagttgtgtcactcagcagcacagcggtgagcctctgggacagaaaaccaaaaggcaataatgggttgggggtccttgtaattactaggccccattttatcaaggtgtgagcaattgcatgagttttcttgggtcatgcaaagcaggtaggctctaaatagcttttaaaaatctacttgtttgggctttaaaaaataattagatgtgtaaaactcttgggtttggcactgtcaggcttttgaactcatttatatgacagagtgggaccacattcgaggagataactctgttgtggtatgttccagccacattttaaggaagaaaataatatttcaaactccaagtgctgggctctcttcattgtagcccagccaactcaaacagtggataagtatgccaggagtcagtgtccgtgtgagcacatgctggccaggcctcgggatctgggttaggatcgcaaacatgttttcttcatcttcatgaggacaaattctttttatacaagctggacttcttcaatcattctttatgaacaaagggagaacaggaaagctctgtttaatgaacttcccaatccagttaggagtaaaaagtagaatacacaccacatttggagcactttatgttaggattccgcccaaaatataccatagttgcatgaaaccgtaagctcactggtagctggaactgggtttgttggagggaccatcataatcactgcctctaaagcaaggcctttccaatgacagtagtgagtaaatgagcatggactaaataaagaacacaggaacatctaagttaccgggctctacatattcaagttgttgtgctgagaaatctgtctggagccatgaacttcaatcagttctcccatcgtccctgccagatgggacttcagtttctgtcctcaccacaaggctgagtcacaaacccaggctgacactgggaatgtggcatttaaactggtgcttaccaagcttataagagtttctttgagtgacccgggagaaggggatggtaagacaaagaaaaccactgattggaaaagggggcatgaggagtccagtcctcaattctcgtacaggtgggggtaaagagggaaattcaagcattcccttagtattttgcttccacctccctgttcccacctcattctttgtaactcaaatcagaacctcctctctctaaaatctgttccctggtacctaggaatcacaggataggaggctatttttttttatcttgacacaaaatttgccacctccaacctcaaactgctcaacccacagctccctccaagcccacccaggttttaaaatgtgctccaagtctcagcattgtggtcagacagtgcagcacctgctgctgagtttagggttctactcatctccagccctacccacctcctacccatgaaagagaaatataagagttctaattgcagttgctaatattgtgtttcataataaaaatgaaaacataatttatttttaaaggatgacctgcaaattttgcttcccttttcctcaatttgcccttgtgcaaaaaccgtggtttgttgctgtcctagttaactccttactgctagagacaggccctatctttcatggtaacacacacataggtaattttttttttttttttttttttttttttttttttttttttttttttttttttttttgagacggggtgttgctctgtcgcccaggctggagtgcagtggtgcgatctgggctcactgcaagctccgcctctctggtttgcgccattctcccgcctcagcctccccagtagctgggactttaggcgcccgccactgcgcccggctaattttttgtgtttttagtagagacggggtttcacgtgttagccaggatggtctcgatctcctgacctcgtgatccgcccgcctcggcctcccaaagtgctgggataacaggcgtaagccaccgcgcccggccacacatagataattttaagaccatgtggatgctctctattcctcatgcaacccatggaaacattgctaatgtgcttctttctaccacgttgcccttcctgtctccctctatcctctggataattcctggtcatccttttaacattacttcctaaacctgtttttccaaatgtggtccatgctctagcatcacgagcatctcttgaaagtatattaagaaacagaatctaaggcattactcccctgctcctgaataagagtcttcattttaaataagtctcagggggcttcatgtgcatgttagagttttagaagcatagccctagaagatatctttctagaaggagtcacacttattttctggcttccatttccttgttcatgcttcttattctattataatgactctaggaaactccttttctagagcaaaggttttctaattgcacctaataaattgtactcactgaaaatcataacagggtagtgaggtcaatttagtgggtcataaccaggtcttttaattaaataaaataaaataaaccactctagaatagaatggaaaatatcaccaggcaagtatagtttcatataactttgaaacagtatgtctatgtgtgtgtccatgtatactggattgtctacatatatttactgtggaccatgattataaaaacttgaaaccctctctaagctccttggactgagggactgtttgactcatttgttgtacatgtaacccctaacacagtgattatagagtagatgctcaaaatgtatggaatgctgtatgaaaggccatagatcattgggagtggcatcaatcattagtgaacatgacatccagtgagaggatgactgacagcagaagggaagaaagtggctggcctagcctggggagtaggagggaaagaggaagggcttaacagatctgagtccctttcttgaggcagacctgtgttcagcacctggatgggattcatgctaaccagatcatgtgccctttctaaaataaaaattttatatatttaaagtatataacatcatgttttgatatgcatacaatagtgaaacaaattacatatataagatatacatatatacatatataagatatacaaattaaatatataacagatacataaatgtatttatacagtcaaacaaattaacatattcattcctcaagtagtgaccattgtgtgtgaatggcaagaaccagccaatatctctgatgaatatcctcaaatgttaccaaactgaattcagtaatacataaaaaaaattatacaccatgaccaagtgggatttatccctaaaattcaatgttggtttcacatatgcaaaccaatcaatgtgatgcaccatattaaaaaagaaatgaaagataaaaaccactggccaggcatggtagctcacgcctgtaatctcagcactttgggaggctgaggcgggcaggtcacctcaggtcaggagctcgagaccagcctgaccaacatggtgaaaccccatctctactaaaaatacaaaaacttagccaggcatggtggtgtgcacctgtagtcccagctactcaggaggctgagacacgagaatcgcttgaacctgggaggcggaggttgcaattagccgagatcctgccactgcactccagcctgggcgacagagtgagactctgtctaaataaaaacaaaaaaacacccacacacaggatgctcttaatagatggaggtcaaatgccttttaaggaacctcagacttcatctggctgtgcaaatacccctaggaatgtcactaggcacggtagagaatggccactggcttgaaaaatactgaccaaaagtagaatttcaatatgtgagaaggaaattaagaattgtgtggggaagattcaggtttgaatcccaggtagaatcttacattgtaagatggcaaaagaaaggtcagtgaaagactttctggaaaccagaatcagatatccgtccatgcactccatagtcattgatgtaacatctactacgtgcagatactattctgaagactggcaatttaggtgtgaacaaaatagacaaaatggctcttctcatggaatgggcattgtagtgaagaaagcaaagaaaaaacaagcaaatatttcatatttgtatttatctttatattatgtttatattatactatcccaaatcctgcattttgtttatattatatatatatatatataaatatatatgtaacatgtaaatatataacatggtgatttcaggtggtcatgctagaagaactgatggaaagtgagagacagtagcacatagacccctctcttagctcccttatctgtgagctaggaaagattaggatgagatgagagccaccccaagaggaaaatatctaagattgattcagattttattaacaaggtttcactttatgttgaaatctggtaatctgttatcagagattagcactgcaatgctgtagaatggtcgagtccagtggcattaaaactttgttctgtgtagcctaagacatcacaactggtgagtgaggacaggccggagagactctggctgccttaccacaacctgtccctctagcacattgcgacttaccatcagctgcatttggggagatgccacgggaagctgtgttttgcaaagttgtcctgctccagaatagctctaatggaattctctaacaactttagctttcagattaagaaactgagatttatcagaattagctgacttgatcaagagcgcacgttgaagaaaagctaagcatagaattatgaatcatgcctgcttttcctgatctcagtcaattataaaacaacagccattctaagatttcttactacagataaaagtgttccaggccttgtttcccttagtaggcaggagagtgtgactcaggccaaggctcatttgccccatttgacattggcattacaattccttacctggcaatggaacctacacatacctcactaggagactttctcacgagggaaaaccaatagggacttaactcattggagttaactcttaagtccaagataggatatcgcatctatcctaccttgatacatcccctctgctctgaatcctggtcagttaaaatcctggcatatgttgttattttgttcgcttgctcaaagggtttccaaacttttgaacaccatgtgttcattcaaatgtactgctttggactcctccttcactctgatttcagccacctagatgatttttattatctctttactctgccacctccaaggaaaaattttccttctttgtgttcaaagtcatccagatgtcagtactttctctaatggactttgccttcgtccatccccaagtctcatacacaaaaagccatgtacacatttgcgtgtaccagccttggtaggtatcatctagttggaagcagctcagcaggaaatatccccaggcttccctcaggctgctttttttttctcctttgggggtacctaatttccattggtcctttgtttattggcctctgggtcatccactattaccaacttgaattgagacaatctgctgtgtaaagggtctaatccttgtctttgcatttactcttttttttccccatctaagtatttgaatacataggaacagatggaactgtttttagacacagttgcagaatttttccttgcagacacgcatctacacattctggtaaactagttgggtaacctgcttaacccattaaaagcctctctgacagccattttccaactgatccagagctaagatgattatagtaaggtctgtcccatgtgcacagagttttcttactttctcaaacaaagcattttagttgaagctgttccactggcttttctaatgccagcccacaggaaagtttctcccaaccactatccataaattctatgcaaccacaccagagatggcagctgcccatttcacagccactcaagctaaatctctccttaattcttgtctccaaatattgtcctcagttcttctggggttggagctagaaacatcacacatccccaaggcagcaacaacattcgtgtttactttagaatacattttgataagcacccaagtgcttcagcggaaactgaagggtatttgtgtgaggtagcagattgtggggaggttttatgtcccagcacactctggggaaaataaaagaaaatagctttctttcctggaagaaaagaaaaataaaaagaaaataaaaaagactaagagccagtgcagacacaaaaagacaagctaagggaaccccaacaacacaaattctggaaagaatggcacctcccctgtcccccacaaaaggctcagactccagaaaaactgtgctgatgatgttggaaaagcttatcgtgttattgggaactaacttccctttttctgtaggaggcaaaacccaagaagtgtaaacgcaaaaagtttctgcgcttctgagtggagaaagttccccaaaatgagtgtgaaaagactaggaacaactgaaaattccagcccacagtttcaagctttccaaagcctgtttgctttggccagcctttgccattcctttctctcttttttcagaagtgtgaaatgggttggttgctggtatttgttctgtggtctctgctaactcttccatctgtataaacttagctctgccaatccagcagtttagcagcactttctcttcagctagctcaaaaggacacgaaggtcctattaagtggccctttcaagacttgcaaataactgtaccatgctgtctgattgaaggcatgaagcttatttatgctgtccttgcaagggctggccttccttttaagacttgtagctaaacaggatgaaggcaaagttaatccaagtctggatttgaccattcctccccagtgtcagggaagcagccgaggtggctataatatgcctataagcctgagaaactaggcccggcacagtggctcatgcctgtaatcccagcactttgggaggcctaggcgggtagatcacttgaggtcaggagttcgagaccagtctggccaacatggcgaaaccccatctaatacaaaaattagctggccatggtagcgcacctgtaatcccagttactctggaggctgaggcatgagaatcgcttgaacccgggaggtggaggttgcagtgagccaagatttcaccactgcattccagcctaggcgacaaagtgagtctttgtcaaaaacaaaaacaaaaacaaaaaaacaaaacaaaaacaaacaaacaaaatcttagaaacttgaagatagggcatggtacttagtggtgatgtcttcctctttttcatgaacatatttatttgaggatgaagagagccatgggagaatctacattcccatgttttcccactttccttctatatttatctgtatttgggttgaccctcttcagcaagctactgtccttcaagaagcaataggctaacagggtgcccacatgcttttatctattctcaatggaacaacctagactatttaattaactgtttttcactagttgctcttacaaagcaaaatattgtcaaatatgaaaatttgccttgggtcagagaccgaatatgagtagagctgacggtttttgccaagtccaacaagtatctctgtgaagtgtaaacagctattaatgaagagagtagccacggttaaataaaccagggggtggagaacacatgggccaagagaagagctatttgttgcacatttcctctgtctaaggatgaatccagcctagttgggtcctcagtggaaggtaacagaaattttaaaatggaccagaataaatagccacaaagaagaaatggtgccccactgagaactagagccccattgtccaccatggcattaaaaaagaccccagttatgtcagatttaaagtcatgagctcttcactgggttctccaagctagagatggcaaaactttaacccagagcttcgtggagaaatttgtctttagtgactatacagtcagagtctatacagtcagtgagtatacagtcagattcattagcctactttatgcagatgtgaatctttctagacctgtctcctccttatatttctgatctagataattcgttaatctgctcaaaaccgagcaaggctggattccacaaaactttttccaaagttttgaaaactttttccatccatacaagtgggcaggtaataaacatagttcccaggattgtgttaagtaaaatgacatttatagaatgcacaatgaaatattaggaagaaagtaagtcctcaaataataactaaaaaaaaaaaatttaaaggctatgggcttacagtgatctggacccaatgcaatgctacaagaaataaaaaagtatatatttgtatttttaaggccaacctaatactgtatcagtaattccaaagaggcagacagaacctgtaaacacaaagaggaacgtccttttcttgggaaagctctccacaccaaaaaccttttcttgtcaaatgaagggtacagatacctaggaagtatttacatttgggagttcatgtagtggaaatttaccttgacaaagtcaggacaatgggaatcattgggaaacactcccaaaaggccaaaagaagcttataacatatgcttcaaaggacatacagttactttttcaaagggccatcagcttttgattctctctggctaattgaactctggactgctggaggaaagagattatgtatcccggtgtctggaataattaatagtgcatagttaatgcttaataaatcaggtccatgacttggattcaaatcttcactctgccactttctgcctgtggtactttagcctctcagagcctgaaattcctcttccattaagcagggagcttaatggaacaagcgccaatcttgtacggtgttatgagaattaaatgactctgagtgttgcatgcttagaggactgcctgacataaaggagtaatctgtaaataatatctagtattattattgtcgttaaagcataatcgtttggttagttatcactgaccactcactcttctctttcttgctaacagaactataacttgtcaaaatcaaatatgaaaattctatctccctttgattgagattaagtctggtatgtgactcagttctggtcaatgacatataagtacagtatctatttataaggtgctttctggtgaagccatcttgtaaagatttttctcgctgaagggagactatatattctatattctcatgacgatgtgatgaccagagctgcactaacctcttaaaaccattgtcaacaatgtttggcagagtaaagtataaaaagagcataggtaacatgagacttgatggcatcatgggactgctgcagcaacccatgcacaatccatctcctgccatctaattatatgagctccaagtctgttgcttccagcagaatgcaaggtaactgatacaatccttttgtgtgtagagtgtgtatccacataaatctacacacatacatgtgtgtgtagtgacatgcaaatgtctacaaggacatatactgtccttttattgtttaaagttttatatttaaattttaaagaattcaaatattgacagatgtacagcaaattatatcatagtcacctatgtacttgctactaatattaaacagatattaatattttgcttcatttgctttagaaatctatctgtccatctgtctcatttatgaaatgaaacattaccagttaagataacgtatctgcaaccatcccttcccttaggaaaacattactgtgaagtaagtctatatacttttgtagttctactacatgtaggcacctatagaaaaacatgcgtttgtatgttttataattttatagaactggtgacttgctgcatatatcatttttgaaacattactatgcactgagtttgatcatgtatccatgtttatataactgctttgttcattgaaactgctgcatagtactccatctgtatggaaaaaaatcttcagacaatatttcttttattgaggaatatctatttgttttgacattttttatttcaattttgttctttttttgttaatgtctcgaaactcatcatatattctagtttctactttgttgtcagttacatggcttgcaaatagctactcctagtccatagcatgacttttcagtttatgatggcttttctcttgccaatttttttataatttaattatatttattagccttttccttgttggtttggaaatttttcctttaagaatttcttcctatcctaatttggaaagaatttttaaatgttttcttctaaaatggtaaaagccttctttttacttttatatgtttaaaccctggagaatttattttttgtaagataaatactaggcatctgactttgtatttttccatatgaataatctaacatctcagggccatgagcgggatgtcccttttttcacagttgatttgctttgtcacctctttcacataccaagctcctacatacacgggggtctacgtggtagtcattagcgctcgtcacaaaatgtttctatttcctcatcttgtaggtacatggtaaatgtccattttctgacccttttgtgcacagtggggccatgtgttctgcataatgtgttatgaacaaaagtgcacatttaattgccagtaggaatccctccagagatctccttctctctgttagtgagagatgttacttgagcatcagcctggatacccaagtgagtaaaatgagcagagtccctctaacaactttcatggacttgcagcacagggaaaaaataaacatgtttattttacacttcagagatgtggaactgtttattactacggcatgacctggccccgtctgactgatacagagaaactggtacactcatgggaaaaacaaccaccaaacatggcatcggctaaagagctggcaccaggtgggagggagcaagaaattaggttgtcatataaactggagggatattgatctgttatccaaatgtgaaacatttggcaaaagttatccctgaaatagcttggaactcagaaatgtatttaatgaacttttagctcaaagagaagaatttggaaaatagaatgtaaaacaagtgtgttggttaacactggctttatttaacagagtgctgcaagaaagagatgggctcagaaaaggaccgactggattgcaaacaggaataaaagcctcaaagagagtccgtaagtataaggacttgcagcattgaaagaaacaactgcttctcattcacatctaataaaagatactggccagtcacagtggctcacgcctgtaatcccaacactttgggaggctgaggcgggtggatcacttgagatcaggagttcgagaccagcctggccaacatggtgaaaccccatctctactaaaaatacaaaaatagccgggagtgatgatgcactcctgtaatcccagctacttgggaagctgaggcaagataatcacttgaacttgggaggtggaggttgcagtgagctgagattgcaccattgcactccagcctgggtgacagagtgagactctgtcagaaggagaagaaggagaaggagaaggagaaggaagggaaggggaggatgaaggaggggaaggggaaggggaggatgaagaaggaggaggaggagaagaaaacttttcaataataagggccaactagaacttaggcttgatataaggatcaaatcgaaaataagacctttcttccctgggaatgctttcagttgcatcagatgattcagatgaatggactaagaatgtgactttacaactaaaacctgatggacttacccttaattaaacagacagaaggaaaagcaagaggagggggaggggaagaaggaagaggagggaagaagttattttaaagtccatgtccactaactggatcctctctgtaactgtttctatttccagttatttctctctctttttcttttttttttcttttttcttttttttggtaatgttgactttttgttacccacttatttttaattcagtaacattcattatatctgaaaaattatagaaaaaataatacttgggattaatgctttctttttccaaggaaaatttatgtttgcttctgataagcagctagaaggaataccaaccacagataatctaattcaagggattgagatactttgaaactaaactttaatttgtacaaggaccaactctttttttcctggttcattcttactcttagagggtagtccttctaaatcccaaaccagaccatggggggatattattaggggtccccatccttgacaggccctggacctccaaattgtgttctcagagttccattaggctataaaaagatctgctcagtttttcagcctctcagctgcctgttctggtagctccaagagctacacctctctgagtttctttcctctctggaatgttagccttgctatgcttcattttttaaaaactgccctgttcagctgttgtagttgttctctataagaggttgacctgcacgttatagtccactgtcagcagaagtcaacttttaatattcacaaggactcaatacagacacacttacaggatcatttttagattcaaagatgtctgataagcgaactaatatcaaagtggaagctgaccagtagaggtttctggataggaaaaggtaatggaagggaagaagagaaaagcaaacaaaagaatgaaagaaaaatcatacaatactttatggtgtaggtattctttgttttacaatgaggacactgtggtttacattaaaactgagctgctcacaatttatgcagatcagaggtgctgaagtccctttcaaattcaggactttttgactccagcctgtatttggttctcttctgctcaacatgcctacctggcattatgcctttgacctctgacagtcttctaattcctgaacgttgggagttaatctgagctctgggattcaactgaaaatcttagctattaaacttgattgttttatctctctccatacctccccctgactatacaagatacccctgttccagcaatactgatcaagcgaggctaactagtcttagttctaatctttattgtctcctcccacgttgttctcttccacaatgcaaatgaatacgaggaatttatagggtgataaggaggcagccttaaagattattaagtcagtgcatggacaatttctctggtctctctacaccacccttcctccttcttcctttctttacttctctctgtctgcctttctttcttctcttaacaaatatcaactgaacaaatgttgtacactaagtactttgctaaggacagaatatacagtggtgaaaaaaatcaggtgatttatattcacctggaccttacaggttaatgaccagtggtaggcataggttgaagctgtattttaaagtttatcaccctggagcaaaggtgagaatccatagaagaccaacgaagaagagaaagagcctagatctctgatggcacattttttagtactggagcccggctacagaactcagatttcctaaggatgtgcccgcaccttcagtgcaaaaatacagaggcctaggcattgcttcatgcatcctcattacctttgagtaacaatgtcactttgggttggagtgaccttgtacctgagaccccattccaacagaacctttcagctctccacctcccttggccacaaccccgactacatagacatgccagctgagggaaagcctgccagtcagaggaatctgcccttcagcatgcctagggttagggagccagaacatttgacccaggaaagagatccacccaagaccttaccagtgtaggtacttttttttttttaattctgagaacaagttagagccaaactgattaaatgacaaaacaagcattgagtgttttcaaaggtgtggatggaacaaactgaaatagtatctgcctcctgtctcctctccactttagtctccccaatggtaatgcccactctgaccgtgaaggcacccttgaaggcaagttatttgtggttatatataattgatcagcaaccataacttttagtctgatttagtcttagtgccaaggggcttccatttgctttcaaaaagaatctctatcctttgttcatttttcccccattaacttaccacagggccaagtgcaatgtaatcatatctcattgtaatcattctgctgtcaaagtgacatcactgcattcaacactatgtttgatgttaaaccatccactccatgtgggtttatctctttaatgcaggcaagacctctattgctagaagagaaacttcaggggaaggagaatatgaatttgtgggacagttctctcctggaagagaaacgggattctgggtgggaacaggggtggggcttgcaaaacttgtgaagcagagaggctagcttcctcagtctttgaggtgaaattcacgtctttataacttttgtctatttatggtggttgttccttctggaataatgtcaaacaagtttttgttcacccgtgacaacctttcagttaattaaatacagatcccttgccctcttttcctttccttgtattttctgttcctcaggttgaacacttcccattctttcaactatttctgatatcacattttggcagaaggaaacatgggtggaaaatattgtgggaataagtacttcatgtacacttcagtaaatgacaactctttctctaacctgaaagccaaacattctgacaccagatcagagcacacttagagtgacatgtcaacattccaaaccgcctgcctgtgaggggaaacaagaaaaacgggaccaaaatatttttgcctatattaattaagaaatgttttttcttcattggttctcatatggaactgacatatttttgtcactccttagaatgatttgaagtttcatattttaacctattaataaaactttccttaagattcatttgaaattactttaatatttaaaatacaactccactaatgtgttttagagcctcatggtctttttatttattttattttctgaaacaaaaataaataactatcctttaaaaagtctctattttctgaaactgtggaaccaagaccaaaccgaacactgaaataggctccacatcaggcacaaattaatatttttattgaatttttgggataatgtgcagaacatacatattggcattttgtaacttctgttagctataaaaataacagcacatccctacctttcttttctgacttgtttagtctgagacaaaccagagaagaaaaggaataaatttagcccttggcccactattaggtgggttctgagattaatcttgtacttaatcttttaatcttagacccgtactcctgtgctcatgaaaggtgagattaatacatgtactaatattactactactgtatcaacacagaaatagttgtaatgctactgattgcatgagagtaattttagtgttccactttcaattatggtggtgcctcttactttaagatagatatttttaaatcatggaaaaagccattaaaagtggctttccaagtcttctatgaaattgtatggtgttaacattttttaaatgtcctttcaaattttattgatgttattaaatattagaaaataaatagtatttaattattgttataattgctagaattatatatatatatataaattaaaacaatgttctggtggagtctgggaagttggcggtaatggtgccataactcttgaatctacccaaatcccacagaagctacatatcaaaaacttaagctcgtgggtatacagtcatgtacctgataaggacattttggttagtgacgaactacgtatgtgaccgtagccccataagattataatattttattttttctgtatattttctctgttaaaatatgtttcaatatgcaaatacttcccattgtgtttcaacaactgcccacagtattcaggacagtaacatgctatacaggtttgtagcctaaaaataatcggctataccagatagcctagatgtgtagtaggctataccagctaggtttgtgtaagtacattctaaaacatttgcacaatgacacgattgcctatcaatgcatttctcaggacatgtccctgtggttaagggacatacaactgtacaataaaatgattcttaggcaaccccatgaaactcaccaaaacaagaattggctgaaacacagagagctatagaaactgagtggtatcaacatcagtgtgagaagtagcagctggagacatagaaaatctgacaaaccagaaaataggagaatccaaaaatgttcccaagggactcactggaaagcacagtgtgctgattttataaaaaatgagttgtactaactccaatcgtgagtatgtacagaggtatgaagaattctgggcactgtgaactctcaaaactgtcccaactccccttgaggaaagatgcctatagtgatgaagagttgttgagcagatctgagacaactgagataaagaaaacactagctccagataaaagataaaagggtggagagggacagggccaagaaatggataacagaaatcaagctgacatattgcataacaacagaaatgagctttgtgaaattagagaaactatcatgaaccatggcttcttgcaaaagttcaaggaaaaaaacactaatttcacataaaaatgagcaagaaaaaacctaagtgacaacaacataactccctacagaaaacacatgtacaaaaggaacaaaaaaagaaggacaggaccacagcaaagacatgctatttctaaatgaggtaagcatattaaaaacatgacataaaatgaaagactaacatatatcacaactggaaaaatatcagaaatgaggtgtaacaatttaggaaagaattctaaataaaagaaaaaaaacttcagaaatgaaaactaaagtagaaggcatacagttgcaaacaaatacaacagataatggctgaagaaaaatataaagtgaaaaataattttaaaaaccaaaaaaagaaattgaaagataaaatgatttaagaaaaagtagcaaatattgaatataagcaaagaagattcaatagaggtataatagcagtctctgaagaggaaaaacaaagcaaaggaataacaaatatgatgaaaaataattgaggaaaactttcctaaatgttaaaatatgcaatttattttatgctaaattatacaatatataatttaaattacatattgaaaagaaaaagcacatacctgaaaaaaaaaatttaacccattgcctgactttaaattatactgcaaggctatagtaacgaaaacagcatgatggtggtacaaaaatagatacattgatcaatgaaacagaatagagaatccagaaataaacccacatacctagaaccaaccaatcttcaataaagtcaacacaaataaacaatggggagaggacacattattcaatacatgatgcttggaaaactcactagccatatgcagaagaatgaaactggatccctatctctcaccatatacaaaaattaactcaagatggattaaagacctaaatataagatctgaagctataaaaatcctagaagacaacctagaaaaaactcttctgaatattggcctaggcaaaaaatttatgaggaagaccccaaaagtaattgcaacagaaacaaaaatagacttgggacttaatcaaatgggacttcatcaaactaaaaagcttctgcttagcaaaagaagtaaccaacagaacaaacaatctacagaatgggagaaaatatttatattaataaattatagttacaacaaagaattaacatcccaaatctataagggactcaaaacaactcaacaagaaaaaataaccccactaaaaactgggcatgagacatgaacagtatttctgaaaagaagaaacacaagtggccaataaacacatgaaaaaatgttcaacatcactaatcataagagaaatgcaaattaaagccacactgagataccatcttacaccagtcagaatggcttttattaaaaagtcaaaaaacaacatatgttgccatgggtgtggagaaaagggaacacacatatactatcagtaggaatgtaaacttgctcaacctctatggaaagcagtatggaaatatcacaaagaactaaaaatagaactacctttcttctcagcaatcctgctgctgagtctctacccagagaaaaagaaattacataaaaagtacacctgtagtcctatgttgactgcagccctatttacaatagcagagtcatagaactgacctaagtattcaccaacagttgattagatgaagaaattgtgatatgtacacaccatggaatgctatgcagctacaaaatagaatgaaataatgcctttgcagcaacatggatggatctggaggccattatcctaagtgaaccaacataaaaacagaaaatcagtattatgtgttctcatatataagtgggagctaaataaagggtacatgtggacataaagataggaaaaaaatgactgttgacttgaaagggaagaaaggaggaggcagggagggttgaaaaattgcctgttgggtgcaatgtcccatatttgggccatgggtacactagaagcccaacccgcaccattaagtatgtaataccaatgtaacatataagcacatgtaccccctaaatctaaaataaaaatatatttttaaaaaagctaattctagttaaattactgggcttgaaaaaaataaacaatcattctgacatctaggcagaaagacaaaagacttacaaaacaagactattagacttctatcagacttctcaatggcaatgttttatgccagaaataaagatatagaataacatatttaaaatactgaaggggaataaatgagccaaagagtttgtgtgcatccaaacaaactaactttcatttgtaaaggctacagacaaacttccctcactttcaagaagtcaagtaatgtttccatgcactcttgctgagaaatctactagaaaacaatcttcagtaaagtaaaattattttatttaagatatgaaaataagaattgatggtaagcattaaatgtatcattccacttatacctaaattttaagaatagttgaagaatgcataatatacaatcattataagcactgacaatacaaagtaccacaattttcagaaatgaggaaagaatgagggaataagctcaaaaaactatttaatgattgcagttatcatatgggtggagtaatatggatattgttattctgagactattgtgtgtatcatgtgatataaagccaagcagtaattatgcaatattccaattctatcatcccctcacttcttgagaaccaggattacttgtgtgaaataaatgacatatagaagtaacctagaaaggtgaattacaataatcaaaatgaactcataactttaaaaaagtttgtgacatttataaaaattaaaattaatttcataattatatataatatatttaacattagtgtacgatcgttctgtccactgaaaagtcctagaaattaaagaaaccagcagcacacaaatattcatgttgtctacaaatatagacagttttaattcttccttttcaattcttatctcacattgccacacagggtaaggcctacattatcaatgttaaataaaagtgggaaagcaggcctcattgtcaatatctcaatcttagaatcatagaaagattttcgcaagttaccattaagtatgaggtttccctaaattttctgtgaggcaataatttttaacccatattttcacttagcaatatcactgtactttttgctttaaaagatgataaaattctcactactaaccttcttgtcatctcatttctccaaccctctatttttgttaaatatattattctttgaataatgccaaagtttatagcattaaattgtgtgccataacgctaatttttaagattattttgctttagttcaggtttaagttgactcattactaatcaccttgtatttattttgaattcagtaccctttgttttcaattcatatttgtctcatgattgccttgattttgtcattgatattttccaaaggagaccaatggatgttctattttttgagttattttgtatttgaaatgtatatatgttgcttttatacattaattgtgatattctttggtctggaaatgtgtcagtaaatgtttaacaactagctctctgaaggaacaaaaagaccagattttagcactggcagttttcctgagacaaatgatttcatcatggctgattccaagctatcaacatggtgccactgaaagtaaacggaaagagatgcttgggagcacactatcacgtaatattttgcagtatctccactgtatagacataatagacataagtaactgcaaaatcatgtataatcataaaatgtagtaaaataattaggaagtaatgagtcaagcatttattacttctgttttttaaaaataatgtatttcattacaagtttctataatttagttttaaataatggttctgtttaacttttgtctgatgatactcctaaaactttaacaagctgggtccaacaactttgtcataccttatttactttagaacgatgctgacaatgtgcttttatattcatgcattaaatgttgctgtagaaacttccgaagctaactttttgcaacatgagaactgaactgatgaactttgccccacttcgtactttaagcacatagaaattctggataaaatggcaaatattaaataaatcaaaataagacaagataaatctccatgtgtgagaaaggaaaaatgaaatcaatgccagagcaataatttgaaactgattcagtgacagctctcaggtgttagaggaggcatggattatagagctgggtgctgagagtctaaagtccattcagggagaagcagctgaaatggaaatggattagaaaatctctgtccgtcatctcagaaaaatagtgagtattaggtcttaggttttggatgacgggaaggaaaattactggcacaaaagaaaaactccagacccacaccactgatagacatttgaattcgctgaatagtacattaccaataaactcagaaactaaccaaaagctagtgtggaatattgaaatccctgagtttccactgggaactctctcatcataaacaatcatgaaaccatgtggtggcaactttttataaggcaagacggaataattaattccttctgaagatgaacaaggtatgaaaaagaagaaagcaataaggaaaagattgatgagatccaaagggccagatgacccaacaaaaagaaaaattaacaacccaagaactagaagtaatggaataatatggaaatattcaaataccaaagatgaataagagcactggatataattttaagataacagaccctattgaaaagaataggtgaattcaaaagggaaccaattagaatttctagaaacaaataataaatagttcactagacattaaaaaatgaataagtggattaaagaggagggtagatgcagctgaaaagaaaacatataaggtggaaaatggagaataaaaagtattttcaaaaccacatgggacatttataaaagattttccaacaaataccaaaataaccagtaccataaatcaccttctctgataacagtgtaattaaataagaaataaatgttcaagaactgaaaacaattcacataatttttataggtttaaataaaagtatcaaaaaaagaaaccagaatggaaattgtgaaatagttgaatttaaatgacaatgaaggtagcacagatgaaatctatacaaagtagctagagcagtgttggagggaagtgaagagctttgaagacaaatattagaaagataggcctgtgatcccacgctttgggaggccaaggtgggcagatcgcctgaggtcaggaattcaagaccagtctagtcaacatggtaaagccccatctccactaaaaacacaaaattagccaggcgtggtggtacatgcctataatcccagctactcaggggctgaagcaggagaatggcttgaacctgggaggcagaggttgcaggttgcagtgagctgagatcgtgccactgaactccagcctgggtgacagagcaagccactgtctcagagaaaaaaaaaaaaaaaaaaaaaaagaaagaaagaaaagaaaagaaagaaagataggtggaaaagtcatgagctaaatgttcagtgcaataaattataagagtacgttgaaactaaagaaaatacaaagttggaataatgaaaatcagagaagttaaagaaatagaaaaataaaacaagatgaacagaattaaaggctaaatctctaaatgatcaataaaacagaaaaaggtctatcaaaactgatgaaacaaacaaaattaagacactaataaacatgttaaaaaacaaaaagacatacatacatcgcagaaacttaaaaagaatattttgaataacttgaattcaataatcttgaaaagttatataaaatgaacaacttattttattttactttcttcataagaaaaagaatgtaaaactatctcatttattttttatagtgattacatattaaaatgtcaaaatggcaatatttaggacatactgggtaaaataaaatattaaagttaaattaacttgtttctttgaactttgtataacgtagctgctagaaaagtgtaaattacactgaacaacttaaattttcaatataattacaagaaatatgaatttcagttgattttagagatgagtctcctttaaataataacgaatctatagattatatgatctgttctagtcatagaaacaaatttgttaaaaaatgaggaaacacttcctaaaatctttttataagacagataacttcaaaacgaaaaattgacaagaaaaacacaagaaaacatattaaaataatgacagtaggagtaataataacttaaagtgatttagctccagacactttcagaagtgatttatacatttacatgttcctcataataaatctatgatttaggtaacatggttgtcctcatgttacagaagaggaaaccgtggcagaaacgtggtgactaatctcccctaagtcacacagatagtaccctgtgtacacactcaaaagtgaaccaaacagtcttgcttgggatcctctgctcttaatcattcacttcaaattttttaacaaaacattagcaaaccaaaggtaacgatgtatttttagcacaaaatgataatgtaaggttgagagagacattcagagtatttcttcttagtcaccaattcacattcctagcatatgcaatctccagtccattgttaggtgcccataagattttacaaattgacaaacatatcttctttctcccaaaactgttcaatctcagatttgttccttttccatccatttctgtctggctatataggcataatacttgatggtcacaccatccccttcccaccccccatcgtacttaaaaccattcaatgatttcccattgtttttaacataatgtgcaaatctctcatcacggcctccaagatttgttcacagctgacctctctagcttcttctagaatcatattctttctggctttctgtacttcagccacactggccatctagaacttgaccctgtgcatttgctcatgctgttctcttgcaaagaactccccactcctccctttttctagctgtcttccactcttgaaggtctcacctcaatatcacttctcaagggaactctccactgagcttcccacctcctaagactaggtcagtttccctcgtctaaattctcacagcactctatcccttttcttggtagcattatgcatacgtgtaaattcacatctatttgtgggatcatttcatttatttttctcttccccaactagaatgcaggagaacaaggcccatagcccacatactttctttctagcattgattaaacactagttaaacaccagtgtttaatgcaatactttcactttgttggaataatttaagaattattaagagaggagaagaaaggagtggtaagttatttgaaaaagatagctgcaattattattctccatgtatccatgccccttgcacctcctcccatcaagagataggatgtatttgccaacccccttgtgatgtcctttcctcaatggaatgcagcagaggcaataatggcgtagtggcattggtgctatttactcatctaggccagaagagatcctgtgaacttctgctgtcagtgttgaatgattatgaccaaggatagcctaatgggggatgcacaaccacagagagacgcccaagcctagaccatcctagactagtcagcctcctaccaaccttctggctgacctctgacacataagcaaagccagctgtatcaaccaatggagactggcctacaaaatcagaactgtcccactaatccctagactcaagagcaataatacatggagtatttttaagccaccaagttttggggtaaagaaaaaaggaagaaaacttaagagggaaaaatggagaaaaagatataaaggtgtgtgtgtgtgtggataaagattcaatgtttagctgcagaaaaaaatgagttcgcccaagaagttatgcaaagagaggtctaggttcaaattaaggctagacttaataaagagctgagtcttcaaaaaaaaaaaaaaagaaatggaatgaaatccttgttgtgcaccatccaatgttatgaataaaaaacaacaacatgggattttggagctagagttttaaatcccagtttactagtactaagtatctagataatgttcttatctaagtgtgtacaatgcagccaatagctactactctgcctcctgctttgggagggcatggtgatactgatgagactatagttctctcgctacaagacctgccagtaaattctccactcacaggtgaattctggactcacttaccgctcagacttgggctgacgtttctcaattagggccccagatgtccctgtgcccgtgggatctcagattatccctagactgtaccacagatatccactgacatgaattatcacagtctttctaaccagctgaggttggagcctgaccttgaatttattctctctggacaggactctcactcccatctgcctcttccaagcagtccttatatgaatgagaccttgagcctcattgcacgtgaactgccatctttattctcacttcaatctatttagccttccttgagctagataccagcaccatcttacctatgaacccagactctactcaaatatgtcactcacgattcggctggatgctctgaacaacaaagttagaccccactgatgttcattaccctgaaatggatgtgatgattggggttgtctcctgtcaccctttggagtccagccctacatcaagtctgttcccgtaaccccacctctgacaatcactaatagacctttgagtctctttctgtagtcgagaggtcctagtacatctcatgagaaggtccccgagggttaggccacggacattgtttaaaaatatataaattataaagtactctacaaggacttagtgttaccatcataattatctcatgatgatccagttcttgctgccagagatgctgctatgtagaggaatgatttgagatggagactggacttctaagtgccttccatgtttaatcatccgaagtcctgcagatgcactgaattccattttaaaattaacagaattaggcaaattaggcaaaatcctattttctacatgaatttcaagtattgtttgatttaaacctttctcttttcaccacactcttttaatctaagtggtagcagtaaaaagatgacccaactaaagttttgccaggtgggtaggtctagactcatcaaaataaaaatgagcaaacaaaaacgaggacttgctttgtgtcagacaggtttctaagtgcttgatgctactcatttattctcacgacaaatgtatgagataagggctatgattatccccatttcacagatgagtaaggcaaggcatgaagaggttaagtagcttacccaaggtcacagggccagcaaataggagggcaggaagtaagccctgaaaacgtaatccagggatctaggctctaaaaccctacatcttccatgtggatgcacaagtcgctgcttccccagtgcccccacctggtattacagagataaaatacagcttggtttccaggccgactctccctccaagtcagaaactcccatctctggtgcacatgaaccgggattttccagttgtgcttggcgctggctccctggagagaatgtagcaaattgggaaggctagaactatctcctgcccagtcctgctaattaaactcctccaactgacactttttggctggttccaaaaggatattatttttagcacgtgagggttaaaggggaagggaagtgtgctagattcaggttgttagagagggggagaaagagaaaggagctcggagggatgcattatgattacgactcgttttaataataagatggagaaaattgggagtctgggccggtctcaaggccttaaggaaggctcctaaactctgtcaacctccttaatggttctgccacatttaaatgggtggaatatttctctactcacacagtcccaatgggcctgcaattgcagattttagaagtatccagtttattttattattattattattattattattactatttcctggaatgaaaagaagagtaatgctttgcaggctggggtgaaaggagcattccatcttccccacccctttttcttgcaaggctctttgacagccacaccctggcctaccctaagaggtaacaaatgatgtactaacatgaccctgattaggaagctgggaggttaatctgcagggctccttctgataaagaccaggccagaccatgcacagctcggccgattgataaactctgggcctgcataaccacaggagcccatctgaggtgtagagtgtgcagttctgcctcccaggactccatctatctacgtcagtttcacacactcacccactgcctccttccttctcccctccctctctgcttctgttccagtgattaaagacgcaagatccctagctatttacccgcagttctgtaagctgtcgaaacccaggggacacagccctgttaagctgaagcatgaaaccttgcacctctgtgatacaaaccatgaaatccttaaaactcaattcacaggaaaaagaacttttctcttggtcccgctcttcatgtgattaatagatgtcattgtttagtctgacagcaaaggctccattgtgtgacaagctaacagttttgctcctggacagagcaaagagagaaaatgcccatgacactgggaagatcatttttttcaggactcaatgcaatgccatttttttaaagagcacactgatggaaatttcagcatatgcaataaacatatactgtagaactgaattaatctgcttgtactgaagggcaactagtgtgcattgtaagggtgactggtaattaagtgtactaattgagaggaggtaagagccagacctggatttgaatctctgctcacccacttactgcctaaatgaccttaggcaagtggtgtctccctttaagacatagatccatccttgtaaaacgagattaataacagttacgtcataaagttgtatccaggatgccatgagatgattctgttaatgctctcagcacagtgcctggtgcagaatgagtccttccctaatattagtggtcattattaggtcagccatgaacataaagaacagggagagacctggggcaagaccaaatccacagcatcatctttggcatgaagtaggttttacttttcaagcctcaataaactggctgcttctaataatcaatgggtacagaacacatagcagttgtcatcagtccagagcaattgctcattgtgataccaaactcctccttcaattagcaactgtttatttaaaatatgctcccccaaaaaagtaaagtctctcattttggagacacattctagagactgtaataacttggattttaatactgggagttgattaacatgtgatacattttacagtaaactaaataagggttttactcatctatgcctcctaagagaatgggaaaaaatgctttgacttgaacattttgaatgatgctaaatcaaacatatagtgatccttaatcttggctaactttgcccacccacccattctcctggaacatttgacaatatttggagacatttttggttatcacaacgagggtgaggggagttgccactggtatctagtgggcagaggccagggactctgctaaacatcctataaatgcgaaggatggcccccaccacaaagcatcatccaattctaaatgacactactgcttagggtgaaaaaccctggcctaatcaaacctgtagggtggtgggagaaaactagatattgtaattgaatatttaatgaaatcttaatgtgtgagggaatttgcctagaatttaaattactgccttgaattgaaacgaatttcacctaataactcatttgcgaattatttgtaaacactgtagtttctgcttttatcttttgtatttaaaaaaagtttgccaattatgaaatactgtgatcttccagattgtcattgtttcaaaagctgctcaaggtggttcttttaatttagtcttttgcaaaagccaagagagtcagaagctgagctaatgctgtctccatcattcatgatgaaaattgtccccgcaagcactttcccctgttccccccaccaaaaagaaaagaaactcattgcaaagatttcacttaccttaccttcaatgtaaagattttcctcctctaaattctccatgagcatggttcctaatccgaggataggatttccccaatggctgagatggtggaaatcaaaacattcgaaaatataaggaaccagatataggtcccactcactgtttagttttctttgcctttcatgcccacagaatacagcattgcccatctgagaaagtcattagtgagagaagagcttttataagctcttccttgaaaatggggcatgcttgctgtttttggaaaatatcagcctggaagagataaagttccgtagagggcaaagctatcaaagccaaaatcacacgattctttgatttcagaggcccttgcttagaatttggcactgccccacctccatttccccctctattcccatggatcaaccaaagccataacacagccctgggagcccagagaggactatagtaaaagtagtatttattaaatgtgagttatgagccaggaactgtgcaaggtgctttagagacattagttcctccagaggaatttcagaagccacaactaggttagtgtaaaaacagtttttttaagggtttgagtagattcttgtttaaactaacacaagcctaaatccagattaataaatatacttttaaaaaatgtcaacacagccatggagttaccgtcttactgacacactcttcattgcctctttccttcttcacaaggctgtgatttccttggagcatggcctcttaaaggcaagtgatttatctgcatctacttatccctatacctagaggaatacctggtttagagtaggtcctcattggttcctgctgaattattgtattttaatcccaacataagtgaatgttttgcatgctccctggaacataatagaaactcttaatatataatatactaaattgaatttatccacaatacaacgagtctaaaaacagctatactatagagtgggtgccaaaatacaagtggactaaccttaaggacagtgccttagggtggtacttgtgaatataaaagactcacttatgtttactagcatggcactgggacagggaagagcctcttagagtgcagaagctatatatttgcacagaaatccagccaaggtttgcaagcagtggtgtctctactctgagaagcagtgtgggctgcagtatgatggctacttggagccctgcactccacctgacctgtgtgtgacccttaaacctgacacctcagtactcagctgagaggagacctgggggatgtggacaagcagcacccagcacaaccaggtatgtgtgatgggaggcatggctcagctgaatggatgacccagcatcaggctcaatcctgctgaagaggcagagaagatagtgttaggactattgagaatgaacatttcaaaagagagcaagagtgtatgctctctgcaaatccaaagagctttctgccattgatgaacgtagtaggcagcagtaatggatagtactagaaagcagtagagccttctcaagcagtagatgtgaggtaaacagtctctcgctgagtggtggatctccagagaccacattactaaatcaggagagacagcactaacaacatttagatatttgaaaaatatcctcagctttaaaataaggataaaagttaatacataacttcccaacttcctatgagtaactctgtaacatctggacatggcttccactgagtccgtaacagagacttcagttgagtgttcaaaggtgtaccacacattggccttcacttcctaccttctattctttttttcatttttggtgagcatttatcatgctattgtgttatttactagggcaagacaccacccctaccttggaggaatgtttcgggaagatacatattacttaacaggatagcatgataatgacaataacagtaacaataacaataacagctaacatttattgagtccctatgatatgccaggcactctgacaggtgtttagaggttggaataaccctatgaggttgggctcctgggatcaaaatccaatgcctacttgatggatgtttctttccaaggtcagaggccatacctccttacccttatgctgtcagggaactggaagagagacttagcaccaacaacatagcaagcatgtcactaagtgcttttgcctatgcaacctgcttcaaataagctgaatcataaagatttctaagacagcaagaaaatatccatccaaacatcataattagaacaacaaatacttagttcatggtgatctactcatttgataaatatgtactgagcatatgctatatgacagatactgttccagcctcagacctgtgcaatgaccaaggccaagaagtccctgccctcagggaaatcacatcctagtggaaaaaataaactatgacaggaaaataaaaagaaagaatacataaatgagattacttctgataagttctgggaaaaaaaattaaacgcttccaagtgatagaaagttcttagttagggtagcagagggtggggcagagccaactgagcagggacaatctgagaaggctccacagggagacatattcaactggaggagccagccttgctgagattagatggaagaccattctaggaagaggaaagaggaatggataaacagagaggcccagaggcagaaaaacaaagaaagccagtgtggctcaagtgcaataaggggacagatgaagacagagaggtcgacaggggactgatcacacagggtctggtgggccatgctaaggtgtccgaaaatgccactcacattctatgtaggagtgtgacatggctctatttatgtttagaagagatcacccatggtgccatgtggctgctgtcctagacagccaaatacaagtgactatttgccattctaaggaccttcctttattcattgaattcagaggcactaactgtggccagggcatgctgccaaactctgaggctgccatggtaaggtggacagagtccctgccctcgagtagcttacagactcctggggtttacagttccacacgtggaaaattaatttctgggttcctccactgggaaggttcaggatattcaagacatagccagggctctaagcccaggtacagagtgacagggctttcgggaagggatgacttcccaactgagattagatggtcataaggagtcacacaggggaacagagggagtcagggcaaaaggtgtttatggacaaggaaatgtcagtgggaacagggaccacagtccagcagggcaggtgtggagcttaggagtcaggaagaggccagagaggggactggcccctacctggagagggctgtgagccagaggtggggtgtaagtacagagtgcagcagtctgcaaagcagggcctcagcaaatcctcatgcaacaggactaaaggcatcttccaggagagaatccagacacaggcgaggataacatcaaaggatttctgtggctggctggttgctttagcattcaaggtgttcttcccccaaccacagctttcatccaggccctctggctccctggctactgtggataagccactttctgcttctcaggaacttgaaggcagttacttcctccaaactgaattttggtggctttatgtcaagtgcccagatggagaaagagaagctgtgattgctgctgctgctcccaaagccgcaagggagctgtttgcacaacataatggctggtgccccatcagcccttctcctatagagcagcacccagcacaaccagatatgtgtgatgggtggcgtggctcaactgaatgcatgacccagcagcaggctcaatcctactgaataggcagaggagatagagctaggacgattgagaatgaacatttcaaaagacagcaagagcatatgctctctgcaaatccatacagctttctgccattgatgaaagtagtagacaggctattaagaacagcttcagagccattcagcccaagttcaaatcctgactctgccacttcctagttctatgatactgagcaagttgcttaaccattctgtccctcagttctgtcatctaaattgagccaaaaatggtatttagtatgaagctgttatgaggacccaggaagttaataaatataaggcccttcaaccagtccacaacatatgataaatattcattaaatgttagctgtcattattccctgtttgccaagttctggagattgagaaatggacagagagagacatgtatcatttattgatgacctactatgtgtcaggtattttgtatatattagttgtaaggttatagaaaacatgcctgaaaattttttactatctcataacaaggtggagtgtatttctcctaaatgtaatagagtgacgaaaattccatactatagatatataagtaatgatttctacataaagatgaggctgcaagtaattatgattggggagaggggtgaagtgtggaagggaacaaggattgcagtggaaagaaattagcggacaatttgactgttgttcttctttagtcatttcttagaattcatgatatttacaaagcacatagcagactacacttggtaatggaatttccctatcttcatttacttgttcccttgttaatgtccatcactgcaagaggcattaagtatggtgctaacatgccagtaaccccacctaagcagagaaacttcagggagccatgtcatgttaccctaccccatcctgcccagtgaaaccagcagggtagccaagacttgctgcttgctcaggacctctgaggaactaggtgcaaaaacccaaatggaaagagacagactcataggattcctctttgagtggcaaattggatgaccaacagagaatcaggagcagaggtaaaagtagaagcatgtgatagtcaaagccatgaatgaggagaaatgatagagtggtgagtaaagccaaccaggaggtgagtgaaaaccaggcagacacagacgtgagcagattttagaggcagtcctgcagtgaggattaggagtctcttgctactgcagccagcaatacctgatttcacaaagcccttgtaagacaggaacccatggtccctgcccttcctgaggcctggccattaactgttccctagggtttttgagacccagccataccaagatgcctgattcagacatccccatttgtaaccttagagcaatagttctcagccaggggtgattttgttccaagggtatgtttggccatgtgtggagacagttttggctaccataactggagatggaggcatactaatagcatctagtgggtagagaccagggatgatgctaaagaacctacaatgaacagagtggacccccatgacaaagatctgcccatcccaaatgtcaacagtggtgagattgagaaaccctatcttaaagagtcaactccacatgacttgaaacaaccgcaggcagctctctgcctctggaaaccgaaagaattcaagaaatgcaatggtttttcacttctgccatattattaattcttgagggcattttggggaatgatagatttgcatcctccacagttcattgtttgggttctgctgcaaagtagtcatttaataatacaatgaatttgccttgtaattgaagatgggtttcaacctctgatttaaatctcatagacaacggcacccttggaaagcgctcaaatcacacataacacttcgtatatgcaacatacatggtttacatatagatacagggcttgttttgtgttgattcttatgtttgaaaatttgaagtttaatatgttggttgcacatcaacatattgggaagtttcacgtgacaagctgtactaggaaacttgggactctcagatgcgaaaaaaaatttgtgatattgagatgtctgtgcaataaagactccaaaaggaaaaaaggcagatgggaatcacagatttaaagaaataacatagagagacatcattctataagaatttatctcagagtaggactgcgggtgataaatctgaaggagctgtcttaaactaaaatataaagatcaggaaactgaaaagagcaaaacttttaaaccaaataatatcaatgaaagttgtaacataattatctttaactgtcatttatttattacccataagatttcaggatccagattaagtgttgtgcatgtcttatctcatttaatactaggaaaacttggggctcttttttcatatctaagatgtcccataaccagttagttgtatagtggggtatggagcctgcattttcagtccaaaatatttttattttctagggtaaagacaggatttttaccctaaatctaagccttcttctgctgagaaaacttgatgggaaattcacctatctcaatgtgtttgctaggacatctctataaggaggagaaacatggatcccttttgccactgctaaatgatcaggaagacatgaagagcattctccaatattcttaccactcttggctatggagcactctctggcataaatgtgtttggctctgttcttcagctacaaaatattcatatccaagctactgtcatagtgatgtcagtttagtgaatgacatgtggaactagattaaagtaggggtagctaaatgtggagaaaacaagtaagatacagaatcaagaaacacacctatttcccaaggtaatacttcaccaaaactagccctaaagaactttctatttctagagattcctaccctttgtaagaaatagccatgaattcttctcagcctgtaaggggaagacacattgttggaaaggtagtttaccctttgattgtaataagggcttgaattttacctgtgcttttccagatatgacctccagccccaagttgtcaagctgactgctcctagcttcctttgagttgatggtcatgcctcatgattccacattcagaaattcaagccttaggtcaaattccatacttctgtgcaaatctatagaaaaactaccttctaaataacctgggattcatcttttaactctcaaatgactgatacttcctgccatacatagaccaaaaagagtgttttctataatttcctgaaatcttatgtagttagaatgtttattatatcttattctactctattgttaaaatatagtgtgtaatatatacgctgtaatatattgaaatatgtttataatacattgtattattaatgttatagtataaaatgatgatttttttaaagattgctaggctttaggaaaaggcctggcacgctatcgtttgcaggctaaagctatcccagcacttgtttttataaataaagttttattggaacacagccatattcattcatttatataccatctgtggctgattttgcactacaatagcagagttgagtagctgtagcagagaccatatggtccattaagcctaaaatatttacaatctagtcttttacagaaaagatttgccaaaccctaccttagaatagcataagaactgctattgggactcagtttcctcattaaatgaaaggtttcgctgagagatggctaaaattaagaatttttttccattttctcattatttgatcaaatccaaatccaaatctggggcctctcctgcatttagtattccagtaaaacgtgaaggccatgtccccaaatatcctaatatcactaatgatgctttacacatgccttaacttctctaagaattttgcaaaagaaatgatgcctgttaggttataactgttctatgctacctacatatatgcatctgtcatgacacttaactctatacctcaagccctttgtccacctctactgcccttactcatctcatgcctacctcttcttacccacgctggcattgcagccataaatcctaacactctggaaagagccagatgtttctattttatagcatgttaacctcatcagtaagctatgtttgataagatgttgtgcagcataagagcaaacctggtgtgtgcatcatgaatgggtgggcccactccatgcctacaccttggtgccaccctcagtcttctccatgggcagtgccactagccttccagctcttctctgctttggtggcttgtgcttctggtcttcaccagccatgacttcaatgtgtggcagcttgcaatgtgtgcatttggtatttggactgtcccctctgacctctggcttaaccttgatgatctgtgcacctggactgtccctagagcatggcctcatccgaccaagcctgtctccactataactctgtctccagttggcatgaggtaagcagtgtggaatcagttagaggccactggaagttgaatgcagctaagcagtggcaaggcccatatgaaatggaaaggaaaggagctaatagggcagtagcttgacttagagaattgaaaggtgcaattgtttaagtgaaccaaatatgttctgctgaactctgtgcctctctcctggcttgagaaagacaagggccatacgtatttgaaagacgcatttggcatcatctgtgtatttggggaaggaatggtgacgagaggttggggtggaattgtgagaggcctaaaatgccaaagacattcctgaaatttttggctaacttgcataagaagcattggatcttcaaaattttatgttaaaacaaaagcccacccgcttacattaatgctttactgcagaactcacacagcctgatggtgaggcagataaacttggggccagactgcctagtttcaaattcggggtccatctttcaccaggtatagaaattggagtttacttgacttctctgtgcctcagtttcctcatttgtaaagcagaaataatagtagtgagcaccacatttggtgatcaggtagagtactaggtcttatgcagtatgtgccacagttgtccacatcattgacttttcacaatgagtagtaatacagtaggaactagcagtatccctgttttacagatgtggacacagaggctcagaacatttaagtaacttgtcaaagaacaaaaagtgaggaaacagcaggatctagaagcaaactcagatctgttcaactcccaggttaggcttttacatgttctgctctactgacttatttattgatttttaaaaatgtttgtagtaaaagtgattctttctcttaactttttagttttggaaggtttgtttctagaaatcactatccatggcccaagacatcaatgcagatggtggaggcaagggctgaggctggtttgtattcagtttacatccttttcctgaaaaaatcaccacagataacaaataagcaagtctgggaaattgtggagatctcttttttgatttttttgatttttttatttttaatgtagcgcatatcattatgtatttttgctaatctagagtatctaccctgttcatttgttgcttctcctcttttatcttctcagtcctttcccttagtaatttctgacaatgccccattgcagaatactagctattgttttggatgtttcatgaagaataaaatctaaacaattcttgttaaaaggaaaggctaacacacacatgcacacatacacacacacattatataacactacatatatatacacatatgtataaaacactatgtatatgtatgtatttgtatatgtgcatatatatacaataatatagtatatgtatatgcatatgtgtgtataattatgtaattggagaaatcttatgctttagtctgaaagttgacatggagcatgtagttttttgtatccatactcaccaaaagctggtgcccattagaaagattttgctattagatgatattgagaggaaacagttaaattgttaatttacacatacatagattccattttggtgctgataaagaagaatgagggcataagttacaaccttggtagactcatttgagctgattcaaaggggcccaaggctagaaaggagagcaaagagaaaggggcaggaggtgaaatgagaacatttctgcttgagttcctctggaagaacttaattagagtccttacttggtgtttgactctgtgctaagtgctttacattgattaacatttcacatgaaccctttgagctaggtattgccattattcctattttcaagataaaaatctgaggtatgagagatgccataccttgcccacagccatgctgctcatacttgaagaagctgaagcaatctgattccaagctcacttgattaagctctaaagccatcctgaggttggcacctcctagaacacagattctctgaagtacaaatgtacacttgttggagtctcagcctaatgaggattagggctggactaaatgtgtgtgtaagtacttcaggaaccacatgggagtgtgtgcattttggggagccagccatagcactaatgtaagtatagtgctgcaccctgatccaaacaataaagagagagagagaagcaaagagggagggagggagggagggagggagggagggagggaggaaggaaggaaggaaggaaggaaggaaggaaggaaggaaggaaggaaagaaggaaggaaagaaggaaagaaggaaggaagaaaggaaggaaggaaggagaagcaaggaaaggaaggagggagagagggagtcaggcagggagagagagagggaagagataaaacaccagcttgtgtcagatgtcacttgcagataagttgagttttaaggacacctgcagctgcaggtaaaagaaaacccaaaggagctcaataaataatccagagatagagagaccctgtatttagttaattcaaatgctcaatcctcaacagagacccaaattctttccatttctctgctctgccatcttaaattatgaactttgcctttaaatgatgtccctcagtgcaaagtagtttgagaattcacatccagatgtaaacacattcagagaaagaagaccgtctattttgatgtgttcttcttaagggtaagaaaacctttctagaacccccatcagttcttgcttgtatcaacaaaaacagatcacagatctacttctagaccagtctctggcaaggggaagggacccccgttgcatatattggcccttagagatagatgggatcctggttaatcatcatgatccctctgcagcagttgatcataacacatttgtgcccatgccaaagaggccatctccgctaaatatatgaacccactgactgcattaaacctgagaaaagggatctaatgtccaactacccaagagcagaggtcccatgagaaagggtgtgtagtttaggaaagcacagctttgtgtgctgtttgtcagtttccctcaatacctagggaattgcacatttatttgtatattggaattggagaggtatcaatagaggcaaagcctctgccctaaagaactttaaattctaatggaggtggggaagcagagacaaaaaaaatagaacaaccttataatttgtaaggtggccaacagtactataaagataaaataaagggtgacaaggaaatagaatataacaagagatgtacatccttccttccaactggaaagatctcttcatcttcccaggctacttgcccaggtaagttaactcctgttcttcttccaggtgtaggtttatgcatcaatccttcatggtctctgtcttctggagctctcccttctcttaaatgaatttctccttcttatcaccagaattgcaatttcctaaatgttcatgtgattgtttagtagatcttctcgagatcataaaaaccttaagaaccaggaactcagtctatttgctcaagattctgtctccagcaatgagcttattgtttagcacatagtaggcacccaagacattatttttgagtgacggaatgagaaaccaaaaaaaaacttaatagtggcttttggtggggccacagaaaagaaacatctttccttggggccactggttcctacctagtatgacacattgcatctcaggctgacgcaattacagttttcctgctctggacaagttctccagattcacatgccttccctgccaataaaggattttaaaatatgtaagctacatattattcttatatcctgtccttcattgggtaacagaagtgtttttcttttgtgcagcttgtaccccactgagacagcacaggaagcacaaaattctatctttccctggggacatgtttgaaaaatactctagagaatagaattgacagccaagactttgtaacacccttgaccaagaaaactatatcccacacatggcttctttgtgtatagcaagccagcagaaaataatattgtatatgtgggaaaatgaacatattgattgtgtttgctgctcccagatacattttgtttcaggcataaaagacagaaaggaagttatggttcactgagtgtctatgttgtgcttgacacttttaatgaaaatactaatgatagaaaataagattgagtgcttgcctgcaagatctcattcaatttttataatgctttgaggtctatcctattatgattcccattttacagatgagaaaacagaggctcagggatgggaagtcacttgcctgtgatcacatgacagatgagcaatcaggatgggatttaagccaggtcatactgtttccaaaggatttggtaaatctccaaacttactgccttagtttgggttctccaggaaacagactcagaaagagcttgagtgtaggtagtttttgtggggggtgatctcaggaggcaggagtgaaggagctgggagagcaaggcaagaaggtaggaaacaccagcataagggtgcttgctgtggtttcaggtcttaactctgcaggatctcttagagaccagggcagttactaccaccagcgtcagtccctgcctggttgaatgtgctcgtaagggtgttaattctcttccactttcaggatgtgtctgaagagggctgagtagactccagagaatctgaaaaagactttgagtcaaaaagcagaaagaagcttagcaaatgcatgaaataggtgccgtcagcatgagtctcatgaaccggactccacagctgcagctgagtgtgtaggtggcctgagggatgcggtgccggccactgacaccaacaactctgttacacttattctagctcaagttctttttcctccttcttcaccatgaccttgtgagttaggagatcagttttcaactttctagctggaaaggttgaggctgtgaattgtcaatgacttgccagaaggcacacagtaaacagtgcccttgggacctctgtttagaggaagagcttcacatttagcttgctttctattgtgactcactctgttcaactaagttatgaacaagcctcgatgcacaaggatgaaagaaatcagatttgagaaagcccagtcttcacccatggacagctgagaaaggcatgagacaggaatattataattcatctataagaaagtgctcatctaaagaagaaaatgctagccagacttcctctgagacacagccaggtaagcaggaaaacgtcattgtctttagaaacagaggagagcttacagtctcttaatatttttaataacctttatatttatacatttatatattgtaaacttatatttataagttataaattaatatttgttatgaatttatatctatatattatacatttataaatatatattttttgatttacattcatttatattatcttcactacagtaactacattcattaaatataaactttgacatcctatcagccctcagaggtctgcttggagtattggagaagacactaggtattttgtctgctttttaatcagtgaatggtctccaaattaatatctatgtatatgtatatatttatattaaataagagtcatttgggggatgggcatcctatgcataatatttgaggatcttcatctctttttccttcaaagaatcttcagcaaatgtgcaaaaacagattgagcaacccatgatcctgtaggtttccagttttgtcttcactctctgaacagggaaggaaaagacttgaggcaagtctctagatttcaatcatccaggaagcaattctgggtgataataagagagactggcaaaaaagggggaaagaggggaaattactggcttggtcaaagcttgcaaaatggcaccagtgattaaaacatcttatgctgtcctcgggctgcagaagctatcactgacaaaagagctcatacacacacacacaaaaggaaagaaattagccattaagaaatatttcagcataatgcaattattacagctgtataattgaatggggaaaccattgatctgtagtagaaaggaaattgctcttctcattgtgttcctatgaatatgtgaacattaatctccatctataatcaacgttcatttcaaatctgattgcatgctactaaacacccgtagctatgctaacattatgttaatatggttcaacatcatagctcccagcttcacagcacaaatatttttctttggcaatcaatagtaatttcagctgagtggatggaagtcacgttttaatggtaatctttcctccaagcctccaagtggaaactcagttggtgtcttaacatggctgcagcatgttgcatataatcagataaattaacctgaaaagaaatagagagagaggaaggaagggaggggacatggatcagaaataaggaggaagcttagcaaaactctagctaatagatgaaagtgtacattaggtagaaaaagagtgaggatgaatgggtagatgggacagagtgaatgtgtgtcggaggggcatgcaggaagggttgttaagaaatgagactgtgttccttctggctataagtcaatgggatgggatggagcagccaggatcctgggcaatttggattttgccaaagcaaccaagatacatgaggaaggaataggaaacttaacaaacatgggtggatggcataccgagtcatctctgcttggaagagttcactcagatatctcctccttctcatatccacacgttcatttacagcaaacaatagaaaatatagaaaattttatagatttctatatctataaaacatacagataattttgaaagtgaaaaaaatttataagggagaatcttttatttttaagcatggctactgctggacaccaagaatatgaagatgaacgaatgtcatctctgatcactaagagttgatgacccagagtgggagaagaaagataaacaactcacagtatcaacccacatctcctgggatcctcctccttcccctggccataataatcctctcccttcatatttttttaaaagaagagagagaagagggagaagcattttggttacattcattcctcaagcacttttttcagccccagaaacctaaatgatggaaattctcagacacaatcattggctccattcccacatccaaggacaatgccctccacaacccccgtttttttacataccttgtctaagactgaaatcagaggctccttctgtgataagaatcaaagttacaacctttatgtatgcaggttgtttataataaggcaaaggaaaataaaacctaagtattctcagcctcttcacctgctctttcaaagaaatctggagttgtcacttcccttcacagctcccccagcccctggcgctctccttcctggctcctgttttgaagatcaggggaagagaacattctcctaaggacagcagggtatccattgatataagaagggaaatccagaggtgaggggacagtgaaccaatgatacagcacaaggaggaccctgcaggacaaaagaccattagtattaagtgtttccttgtttgaggagttcagaaagaggagaaaaatcctgaaagagaaactgccaaggatatagaaaatactgaaaatgatggttatagggaaacagatttttttgtttgttttttgacggagtcttgctgtcgcccaggctggagcacagtggcaggatctcagcacatggcagcctccacctctcaggtacaagcaattctcctgcctcagcctcctgaatagctgggattacaggtgcctgccaccatgcccagctaattcttttgtattgttggccaggctggtcttgaactcctgacttcaagtgatccgcctgcttcggcctcccaaagtgctgggattactggcacaagccactgcacccagctaggtaacagaattttaaaagctttttctgtatattttgcagcttgtcccactctgtctttctctaaaaagacctcagtaagaaaattaatatccttttcctatttgttttgctctttataatcccgaagtgaataaagatttccattgcttttccctgtttattttttataatttcaaaatgccttgtgtaggatgacagtgattatgattattatcaaatagaatttacgtaacaatatcaggaactattcagtttcctctctcaaacccatccctctctttttatccctaaaactcttgcccacctttaatcttctgagctctccttgaattattgcacctgcctcctcctgtcctcactaaactcagtgttactcccttctcatctgtcacctgcaaaatagccaataaagctagcacaattgggcacaatttttaaggcatttgaaaattaaggatccagagcatgaaaacgggactatattttttcagccatgtttaaagtcatgcaatacttaatgaagtactacttgatgaaattttactaaacttattgttaaatgtgtagaagcttattttgagttttattgcttattagcaaagccagaaaagaaaaaaaatcactggggaaatattcaatcttccaaccatgagaaaaaacagctaaaataagacactgaaaacaatatggtgacaaataaaaatgcattcctttgttagcagattctgtctgaagatacagagaaaaaccttgctgaagatttgatgagtcaactgctaaaagaaattatttggtgtgtgaggtttgctatccagttgggtgcaagtatggatgcttctaacatttctttccttatggtatttgccacttgaaatgcagaatagttttttattttatactatagagtacatgtaatggggaagaaatattttagcaataaataacttcattatgaaagcaatattttatcaaataactggaagtggatctatcaatacagtggctgactgactggaatttactttttaaaaatgtccaagtcagattacaaagatcgctttggacataaaattcaaattgcattatcatgtcgatagacaaaaaaaattttcgaagctataaatgcacaaaaataattatatgttgtcatcaacaggcttaattttataagagaagatctttaaaatgtaagagaatatttacctttataaggaggtagagcgacattaaaattatttgtttaatgtaaacaagaatttaaaagagctgccagatttgaagttatctatttttcttttataaaatgacaagtatggcctggcgcagtggctcacgcctgtaatcccagcactttgggaggctgaggcgggcgaatcacgaggtcaggagttcgagaccagcctggccaacatggtgaaaccccgtctctactgaaaatacaaaaaattagctgggcatggtggtgggcacctgtaatcccagctattcaggaggctgaggcaggagaatcatttgaacacgggaggcaaaggtttcagtgagccaagatcactctactgcactccagcctgggagacagtgcaagactctgtctcaaaaaaaaaatgacaagtattccaagtttattgaaattactttctgccatgggagtgtctttcagtataatgtcatctggcagataattaaatggtaatagtagcaatgatgctaataatagtaaataataataaatataatctctcacttcaagattaaggtgacattttaaaaatgtggaacaaatatctgctatgtaaatggagcaggctatggagagtgtttcaaaattgggtatttaaaaacattcctttgttataagattttattgccaaaaacaatacaaacgcattagttacaagaactttcatatatacatcccttaaaatatataaacagcattgtttaatctgcataaaattctctaaacaaaacattatcatagaacttgaagtttctgcattaacatatggggaaatactttcctattctttataaaaccactaattggcattattgaagatagatattttctagattgcaataaaaactgttgcacaagagatgcataaaaggaaatggaaaaatgatgatgatgaggtaagcagagcctgggtgcccttcttttgcgttttggtctgtgtgccaattccactgatctattgctttgtaacaaagcacgcctgaactttatcattttctcacacagttacggtgcttggcctcaacttagtagtttttgctttgggtctctggtgcagtcacaatgaatggggctggaattatctgaaaggcttcttaactgtctgatgccttgtctgaggggactgaagtgactgaaatgtctgggtgctcgtggggcatctttctctctcagcagcctttccctgtggctagcttggctcccctaaagcatggccagtccagcatagtcagacttctcccatgatggttgcttttccctagagtgagagttccaatggacccagatgagtctctgaagtctctctctctctctctttctttctctttctttctttccttctctctctttctttctttccttctctctctctctttctttccttctctctttttctctctttctttctttctttccttctctctctctctttctctctttctttctttttctttctttctttttgacagagtctcactctgtccccaatggcgtgatctcggctcactgtaacctctgcctcctgggttcaggcaattctcccgcctcagcctctcaggtagctggaactaaaggtgcacaccaccatgcccagctaatttttgtatttttagtagagacagggtttcaccaatttggccaggatggtcttgatctcctgacctcatgatccacccgcttcggcctcccaaagtgctgggattatagccgtgagccaccacgcctggcctgaagtttcttataacatagatttgggagccccagaaagttaactttaccattctattggtcaagatctctaggaccagtccagatataagagaaagggaattaaactcaacttctcaatgcaaggagcatcaacagtacacagaaagaactgtacacagaaggaactgaagacagttatcaacttctgtatgaattggctaaaataccatatctaatagcacctgctactgttctagcatataatcagtgcttcgataatgtaaagaacatgcagtcaagtactctttaaaactcaagcacagcttgtgtggttatgatgactgattccttttcctgtttgctttaagatgcacagcctgacaggatttttattttctgtttggggaacagaatactaacaggtcatgtttattgagcatttctgacatgctgagctcttttcacaaatgattgaatttgaacccctccacaaacctttcaggtagataatctgtgtccttgaattctgcaaataagaagagtaaggcttggagaattttgtgacttttcctggatttcatagcatataagtagcaaatgaatgagaataacccaatttagctaatatcagtgactgagctctaaactgctatgtactagaaaaaaatctgcaaatataaatatattaaattatattttattatatattttatgaattataatttttaatttttactaattttgtattatttttatcctagtttattaaaatattccacataataaattatggtatattctttctatggaatacactgtaactatcacaaagaatgaggtaggtgcctatttatattttgaaaacaaagttacagatatatagatacatacacacagataaaatacacacacactaacatatatacagagaaagagaaaatttccacaataagatacatcagaaactgttacatgtagttaacactggaaaattggatttgaattttttgacagaactccattttttttttttactttattatttagcgtcatagcagatgctgtcccctccctgcccatattccctcagcccacccctaaggttctctacagccttgtctacatttcctatatacaatataggactttatatacatgaatgtggcttctgccctcaagccctgcataactttagtctctttctctctctctctctccctcgctcgcttgatctctgtgtctccctaccccctattatctctagatagatagatagatagatagatagatagatagatagatagatatagagatagatgatagatagatagatagatagatagatagatagatagatagatagatagatttatcttgctgtgcaggcttggggcagatcagcagtgcttggaaacaaaccttaaccaatgagggacagccgttatggatacattctctgacctctcagtgtgtcctcttcccagcgtgtcctcttcacagtctctcaggggccccagtgggatacagcaccggttgcccccagaagtgtccctctccttgtgcaccggttgctatttatgctatttatgttccctgcctcacttcccattccctcaccaagtgccctgggattacctcccagataaattgttacatcaggtcccttatcccagtatctgcttttgggagaacccaaaactaagacaaacactatttgaatttttgcaatatgctcacataattttcacacaaataggcaagcaacatcaactccagtttaaatgaataggatcattgaaaagtacagtatttaatgcagcgtggattgccctttccctgatgcacattctgggtctgttgccgtggctctgagtagcctttcagctcctaccaatagagaagaagagattttgagggccacaactgacgtagaggaaaagtggtctctgggcaggggggtctttccaataaggcttggaaaacagggtttcacccacacacaccatgttgtaaaaaggtgccatgttttgcttctctgtttcccaaccctaccccatccccagccatctttcgttgaacactgcttcatgctcatcactatgccgttaccaaggcttgctgagctccacacaggctcacaggctgggccaagagactccggggattcattgtctgggtctaacacagtgctctgggccctggcccaggggagctgaacaaagtcgtctcaagattacaagccatttcagccctatcaggggttatggcccctactttttaacatcctgcttttatttgcaggctatgaagtgtaatagttcaccattttggtttaagtatcaccataaaagtcagtgagatggaacaggcaataagtagttcttttacatagtgtggctgaggctgggagcttacatcttcattaacccacagaaacggctctggaataaaatgctggggtgggcgctccttaacgtcaacatctgtgaggacgaggccccctccttctaactccgtgtgccacactttgccccttgctggctctggtgctgaggaagttggaaaaacaggaaggaaaagagcagatcaatttcataagagcgattctgagtgtgtggatgaaacaccaagctttgcaatggaaagtgaaaaactcttctcaacacagatgtgtttgattagtaagacacccccagcaccatcctccaggcaccaagtactctgattagctgaagttccttatctcacaaaataagcatttccactaaaattagattaacaaataatacaaataattgtaggcttttgctgatggaaaatataagtgctcatgtcttccatccagaatctgtcccagagagatagagttggtaggcatagtacatacaataagacaactttattttacttagcagggtggcatgatatttgcctatatcagagtttctggtaagatttcctgcataacacccattctatggttttatgtgaaagaaaaaaagtttctcagtgaaacaatttgagtggaaatgttaactaaggacatttcactatacagaacttaagattcaaacagctaaatctgtttggtatgtatatgttggtatatataaaaaattcctaggattctcactgaacattttctcaaagaatatttcttggggttcagatttcatgcctcactgacataaaggaactgcccgcctcccacatcatgcatgcgcagaagattcagaactttaccccatccacaataacctaacatttgagcacaccagaatcaagaacaaaactgcactaaaacacaccacttaggttcccatcctaagggaaccttagggctgctctctggtcccatccttcttgcccaattctcagctccctacccctaaagtgataggataaggtttcatagccaagagatatattttatctcattttctttatagccgagccattatttcctacagaattattagtctacctcctttatcactctcagcccccaattccctatttccaattttacccaacagatttttttctaaaaatgaatagatctatccttgtcctacaaaagagatcattgaacataccttcttccataaccagtacttagtatgtccttaggatgcattcaggacttttctttcttttatataaattttcttaaggattaaaactcttcagagtggttatcagatttaatgggacctaaggaccacatgaccagaggacacccatgtcatgtagaagagatatatgcaactccttatttatatattcataccagacaacactaatgaatcatagaataatctccttcccttcattcctccacctccatatgaatccaaatgtttttctatgggagataaaacttattttccctctctatcttagctcttgctttctgaaaaaaaccagtaatcttgaaaagtgtttccagtctttctctttctcacatagatgaagtgatagctatgtggttatctctcacaaaacatgcatcattgcggccagagaaaccaattccctatgtcttgtaagctctttacagacatgcccatgttgaacagtgtctttcaagttgtcaaacatctccctttttggtccatagttacccttcacctgtatcatgtgtacatcatgaggtaatgaaggaaaaaagaacattattctccagttccaggggcttgagtcaagtgacactggagaagtttctgctctactaagtccatggctatgaaaagactattccttaatagtgctaaattgcaacaggacagtgcagaaaaccttgtctttggacacctaagagataatgcatgttgtctcaccagtaagtaaattcatgccaaacagaaaggggcaagtccattctttcatagcattaattgcaaaaccaatcttagtttatcatacaggcagctgcttctgtatcagcccagagtctattctcagcaatgggataacttgaagtcactcttgggcctcattgacctcttggaggtaaagaagagagctaagatggtagcctctgtcatccacacacagaaaagtcaaaccctcaacccagccatgataactgaacccttgaacacaccagaaccaagcactccacgacttgaacatacactcatcttcccacctggttgcagctgttgctcacatactgactcctatcttctatacctcctacttggctccttagctctaaatgataggatgagagatgcaaccaagcccccaaaactaagctcccataaaagcagacctttatcacatttgctctacatggctatatttctgattcactctcctccaccaattcatcgccctaaattccactttccctcaaatgtcccaacaatttttcattttctcacatttttcgcttttactttgttttcaaattttacatttctatacacttgactcactctccagaactattctgattattccattcagctgcggtgctttcatcagacttgtgttgatgctcccctgggcattctctggcctgtacttggggaccaggaagttgtttctttaccaaccatttatacaatttccagggatgttgctgcagccctattcttactgccaccttttttgtcaagaataacatttctaataaatgaatagcagcagatcctctccagaaaaatatacggggctctcatcagagtaccatcttattatcccttttcccaaagggatccctttgtgggcatctgtatcacttactatttttctttgcacttaaggaagcttggctttcgcatctttgaattattcctctggcacctttagatatgcaccaggcctcaaatgtgcagttagaatagtaaattttcccactagataaaggattaaatttgccacgacacatcccagattacccatatgggctggcttgtctccctcagtgtaagacactctgaaacacattgaagtccccaagatatgagtgtctaaatctttttgtgctgctataacaaaatgcttgagacttggtagtttatcaacaacataaacttacttctcacagttctggagtctgggaagtccacaaccaaattacccagaggttcagtgtctggtgagggctgttctctgcttccaagatggacacttgtttctgcatcctctggagcggatgaattctatctcctaaaaagggacaaaatgagcagacttgacttcccaagccctttacgatgcactaattaattcaagagcacagaggccttgtggcctaatcacttcctatagatcccaccttttaaaattgttgcattggggattaagttttaacatgagttttgaaggaacataaatattccagccatagcatatgagtaagacttagcctgttcccaatccttctgtgtcacagcacaacagatacccccttgaacttgtgactataactgtgatccattgccttgggcctcagacaacagaacagaaaactatcaagaccatgaaggtggggcaaagagcggtgggtgtccagaacttcaagcacgcaacatagtctttcttagattaacctcttgagacctccctagagagattacttttgttcctaggacacagttatcttaacagcattctcataactggatttcccatctacatttcatttcttcattctgtatggatatgccaccccaccagaggtaaatgtcctactgctgatttgtggatactttatcacttgatgtgcttctatctgtatccatctatttgtctgtctctctatttactaaatgatttacctgtgcagtattccagatgtttggaaatgctggaagtctgaactctgatttacagaggagatgttatgtaattcaacatgatttaaagtgtcacacaatctgtctatatttggaaatatctactctcctggcatcatgcagaaccagacacagcccaaggccttatgtttcctatttaacttaacaacctgcataaatgtctcttttacatattatcaatgtgtctttaatagtcttgcaattcttgaagcaatcccaatctgaataagcaaaatttttgcaggctgtggtatgtaaggatccaactggctcacacaaccaagtagaatttcaaaatacacatactagcccagaacagtgtctttcatgccttttgaagaacactcatttttaattgttgtatttgacatgtgttcaagaagaatggtctggtaagcgatctttttactttgtttttgtgttcgtttgacatgggatggggtgtggggtgtgatttactaagacaactcagtaaaatcctataacaataatgcgctttcttttttgtgcgatgacatattgttctccactctctctcagtaacatatctgctacaaatagtttctacaaccctccttgaaggcttccaacaaccacacagatgtctctatgcacagcattagctgtggaaagaaaaactgtgttaaagaagacattttccagttacagggaaagacagaaccactatcttagagtgaaagtaatacacggtgagtcccattgggatagccttggtgacccctcaaggcaagggattcagacctactggtatcatgtcatgtctgccaaagggatggctaccagtgagctgtaatatgaatggaactagaagaaaatggaacaaagaaacaagatggtcggaattattccccagaatgaataaaagtacccctcaagatcgcctatccctacattcattgaacagctttttaatacctgattcagtctttcctgcatgttaacaccatgaaagaagtggagaagatacttgataaaaagcagaagtaacttttacaccctaaaggtagaggcaactctgaaaattgattcaatgttctctggtttatacatctattgtttatgagtttaattactatgaattggttccatgagtttgatcatcagaacaagaaccaatcaagtcaatttcaggacatgcaaagttgacagagctgtcaatcaagggctcttttctttactctgaccaattggactccctctttgggggaatgtgaatcttgagcaaagtataaaaatttataaatcattggaacaaagtatttctggaggaaatctttgagactttccatgagtacctgccactgacatccctgaagatgtcctggtttctgtctttctcaaagcctggcagttcagctttttttttctttccactcctgtgagatatctactatatacttcataaactacatctttctatttgcttccatcagcctgatgtggattctatttcttgcaacgcggagaccataagtcattcaggacctgtaaggccttttctattcaagtaaaaatcgaggttcaaggaagccacaatttatttaactagatttcagatgcaggacaggataattaaccttttattagggaaggtatgagccctgcctcctcttcccccggcagagacaaacaattctcctcccaggcctgactgagcaatatgattatttgagcccacatgcatttgcacaggaaggagctgctggagcttgcccaggtggccaggccagcactgagtgctggagggcccaggaggagggctcctgcctcaccctgggcggtcgggtggaaataaactgtgtctaccgcctggttctggcagcaaaagcagcaccagcaccagaggaggttcggactccagaccccccgaaaccaggaaattccaagctggagctaaaattgtagctggccctcccagtcttgctcccagctcaatgctctgcaagcctcagcacagcatgtatccacacacaaagttacccacacgggttgaattatggaggcacagaactgttgaggccaaggccctctgtaacgctctcactctctgaaccctggggcaagaaggatccttcacccactgtttactttaatacttggactgagctggctgttaattttaaccgtggcatcagaaacagaaaactagcatttattattgtcggccagacactgaactagcgatttaatgaaattatctattcactctttccagcaatgcttctgtcaaagtaatattatccccattttacagaggttgcccagggttggttgatgtatgtgtgccaggtttgttggaatttgagctcatatcttttgtctctaaaagcctagttaactatttgatattttcttttttttttttttttttttttttgagacggagtcttgctgtcgcccaggctggagtgcagtggcgcaatctcggctcactgcaggctccgccccctggggttcacgccattctcctgcctcagcctcccgagtagctgggactacaggcgcccgccacctcgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggcctatttgatattttctaactgatggaacacagagactttgcactaagattattctcaagtggcctttagaaatcataaaactggactgtaccactagacttttctattgatagagccaggaaatgctgttttctaggccaggagattttcctgtctgtcctggcaaagtccattgtcattagtaggattgatcagctcacaaaggatattacttgaaggagagactcctggactgagaaataggaatttaaacccaaccctcagctatgtctggacaacatggcttctaacacttacctcctttgtatcctcaacccttttgtttataagatggcatagcaatgtctactgtaacagcagtgtgcagttgtgaataaggcaatgacctaccaaaatcagggagggaggctatctgccctaatggagataagtttttatttcttacattgtcaagactctgaaaaaagggagggatttcagttagttttattattgttttcaaatcctctatggacagtgcaacccttgtaatctgcaagcgtgagatcctcccaatttttctacttctgcatgcccctagatcaagaaatttaccagaaaaatgcaaggctgctactagaaagggacttatagaccatgaacatcaaattgatcacttacaaatccagaaattgatacccttaaaagagaagtaacttatctaagatcacaaagtaaattagtggcagagtcaaggctaaagccaatctttctcacaggaattacagcacaaatgtaaggtggtattatactaatattgatggccgtaaaaagatcccaaatattttcaagaaacccaagcactaaactctggcccttggatggcatttactctgatggacgggacgttggatttaaattccaaagacttgtgctcaagtctttgggtactgataacctcctggggaaggaagacaagataggaatagttaattaatactgcaaggtagaaatgactgcccaagataccaacgcaagacatttcagaaagcagcacatgatgagttgtcaaattagtggagccaggagctaatgctctgagaaggcaaaggagaaccaccaccttgcctcctccatgaactccccagctctccctgcattcctgtggcttcttaagcctttaatcagtaacctgaacaagtgatttgcttgataattatatgtttatgaaacatgatatttgggggaaagaaaaagtgatttggagtcaatatacatgtctttacagctcatctttgccatctgctagttgaatgaccatgggcaagttcctttgcctttgagactacaccttcttttctgcaaagagaaaacaataatccacacttctcatgactgaaagttaaatgaaaaactagatagaaagcatcaaccatcgtgtttgcctcttgttgaatgtacttctttgtcttcggttagactgcaaactccttgagggtacgttcaggctttgtatgactcagcatctttcatggctccatcacaattatataaaaaaaaccttaaagaatataattggattgtttgtaactcaaaggataaatgcttgagaagatggataccctattctccatgatgtgcttatttcacattgcatgcctgtacaaaacatctcatgtatcccatacatatatatacctaccatgtacccacaaaatttttttataattaaaaaaattaaagacattattgatttgaactaactcaaacatagtcaggagagaggaggagaacctatcttgattttttaaaaaagaagaaggttggatttatactacctttcactgagtatcagccagagtgtgagctgagttttcttaacaattgatcataacttgagtccattgtggggcatcatcagttcaatgcatggtggtgccaataacctaagaaaaaatacttccctaaatatcttgaaacccacatgattttactggtgaccgctttaaggcttccatatgataagctccacaacatattcactttcaaggggcatgtaaactgatagaaaaccacacaaaaattcagtaaaatcctcatggcaaaacctgagtcacccaaaagaaaactaacatttatcattacagacataagtatgctatagcaagattaggtacaagtactgaatagcttatgaaaataattatatttattatcataaaaagaatgctttatcatatgcaacaaagagttctatattggaagaaacacacattcacagatctctgtatacagatatgtggataatattttccacgtacacacatgtcccaatatattttccacattttctacaattcccatcataaccagaaaataaattcatgcttattttccctttaccaaatcaatctagctagatagctggctagctaccgctatctatctattaactatggatcatcttaataaagagaaataaacttgagtttgctttctgattatgatgggaattgtggaaaatgtgggggaaaaaaatgaaatttttaagttagggtccaaacaggagacaaaaaccacacagcaatttgaacaggaaatgttgaatacaaagaattattaactataacatggaattacctacaaaaagcgaagagaattccaaacaacaaatgaatggaagaaaagaaagcagccaccagctctaggactaaggcagagaacccaaggaaggaacaaatatggaagacactccctttccagagttgacatccacatctggatggtggctgtgctgctttggcccactggatgagggaagagttccctgaggtgtgcacctctggggtgctggaggaagccgcgtaggaaaacgtcatgccccgggtggtagtgtggctgaaactccctggaggtgtgtgccactgggtgtcctgctgcccgcctccctccagctgcctccagccaggggagcaagacagaataccggaaccaggatgaatccctcgtcccagtccagtgtctctcctgcgccctctactgacaaagtgtatccctgtgtccacaagcaaaggaaaagtactcttgtcccaagcagggcaatgaagggtgaacgtgaagctaagaggcaaaagttgataacagcacatacaaaaaaatataaaaacaaataaataaagatcaccaacaatcccaacaaccaaaaataaaatcttctactgatatttcaaaaaatcttctataacctgtatttacttgggaggggtaatgtctttacatattttttaaacaactaagaacatgtgttaagtcaatttaactaagtttcttttcaatttatcataagatatgttttataactaaaaattatctttcacatgatttttattgggtgcataatattccacaagggaatacttatttaagtattgttctatttttaagtatttacatttttatttttttctttattacagataatgtatatcttgaataaattctttaaaataaagacccacagtagattttctggtttcaagtttcaaccatatttaagaatcctactatatatttttaaattgctcttcataattataaagccaacttatatttccacagaagcatacgtgaatgtccatctcatcacattctcatcagcaaggagtagtaccacatttaaatatgtattgttagatttttaaaaatatacaagttaattcttacatttttgatcactagtaaagttggcaattttttacatctttaagttccacttctgaatatttgttttagccatcttcttgaatttttggtgtttttatttttaatatgtaaaaagtaaaaagctatttgttaaaacaccaagacaattaatcaaaatattacagtatagaagtggaatgatacttttaactatgataaagggtgattttatcacacacaacaaattgggtagttgtgacaatgatacaaataaagagtttattttacatttttaaattttgttatatttttcgtataaatatatattctttcttataaccaggaaagctatatcttcaaaatacaaggatttattttttccaagttatatccatgaccatatttaatggataacaccagaggtatacctgctaaaaatcagcaaaaaagaacaatgtccactattattactaacattgttgtggaaattgtggtcaagggagaaatacataaaaaagacagaaaaggtgtacataaaggtaaggaaggacgaaatcattattcattcactatataattccaaatataacacagaagcatttttgtcttaagaaatattctaaggtctgtatgtaaggatgaataagtcacagtccgatatggtttggctctgtgtttccacccaaaatctcatcttgaattgtaataatccccacgtgtcaaggatgggacaaggtggagataattgaattatgggggtggtttcccccatactgttcttgtgatagtgagtgagttctcatgagacctcatggttttataaggggcttccccctgcccctttgctctgcacttctccttgctgccgccatgtgaagaaggatgtgtttgcttccccttctgccttgattgtaagtttcctgaggcctctccagccctgcagaactgtgaatcatttaaatctctttcctttataaattacccagtctctggtatttcttcatagcagagtaagaatggattaatacaccataaaaaagaatatttgaaaagaataattgataaggaggtggactaggtggtaaaccaaagaaaattcctccctgtatgtactaaggcttaatatcaaacaaagcactgcagatcattgggaagtgaagaattatgccataaatattactaagatgaattaacagttaaaataaacaatttctgtcctctcataccatataccaaaatacattttacatggattaaaatgtcaatgtgaaaagcaaaactgaacagttgtatagcatagatttactaatttgttaaaaccttgaggtaagtgacaagaaattggaaagctataaaagtaattgaacagattaaatatttctatgtatcctaaatatgtaaacttttaaatgtagaatgttatgtatcatgaaagtattcatgaagtaatattgcagatggaatagttttacatttgtttggttaataacatagataaatcaataagaaaaacataacaccgttatagataaaagggcaaagaacatgaatggaggactattcactaaatatgaactagaaccattaagtaaaggtgagaaaataagctaaacctcattaataatccaagaaaactctccctgtggtgaaagccaaaactgagcatctgcttgtcaacaagctagattttgttagaaccatctgagttactactcaaataactttcagacaatggcaaattcctcaactccaaatcctgtttttcttctaataagaatagttgtaagtcataactcctcaagtgtgtgtgtgtgtgtgtgtgtgtgtgtgtgtgtgtgtgtgtgtgtgacgaggcgaggccctaaataggcacccagacacatgggaacctttatttcttgacctttgtctctcccagggtagcctctaacaagatggcttggatttgttttgaaatgtcttctccagagaaggattcccaagaggcatcatgtagactaaacctttggagctgcttggcacaatgcctgccatggtcaggccctgggaaatgctgcagagccctgcaggggaggtgagactcaagagagagacccagccccaagcccaggactcttaatttatgtttctgctctggcctcagtgctgtgaacaaagaaactgatgggatttatttaagggagttgcctctcccctcccctcaacacccatctatcttccggaatagtggaaagagtgctagatttggagaatcccagttccttcagtttctgaatgttgaccttcttatctagaaaatggggtcagtaatttcttccttcctgttgctggattattgggaaaaatgtggttaatgtatagtcaattacgcaagatggttcagcctttgagacaaaccagacgttttggattcaaatcttgtttctgcaactttgcatccttgagaaagtttgtttaacctctctgtgctcaatttcaccttctgtaaagttgagattatttcttgaagaattattataggagttaaattacgtaatacacccaagcattgtagcaagacctggaaatagtgttattattactagtgctcccagtttagaaattcttattccagcattccttcctacattctcttcttaattcaaccctgtctaactaacatgctctctttcccatttctgccaagcatcgttttatattttatattctttcgatatttgatgccatctgacataacgaatgacattttcctagcataattgtcatgtatctgaggtccaggaccacattcactcattcattcattcatttattcatgcagcaaatatttatctaccatctacagtgtcccagaccttgtcctagactcttgaatacattcatgacttcaagtcagtcctgatcatttaaatcctagtgttcaagttctaacttggaagtcaggcaagtaaccaaatgatttcaaaaccaagtcataagtagataatagagtaaagaaaagaaccttatgggaaatagagctggatgggattcactcttgctataagaattagaaatcctccactgggtcatctagccagggatctgaatgtacccagcaggcaaaagagagaaagagtaccccagatcattagaacaaaatgttaaaaagcatgaaggtgtgaacgtgtatgacctatataggaaaggtgataaaggtgactctggcaaaagtatagggtatgtgagaaaaaaaaagaaagagaaaaaggaaaaaaaaatggctacaagaagtcagatggaaaaaaaaaggcaaggagaagaagagacttgaaaaactgggttaaggagtttggacattttcccagacattcagggttttcaacatgtggccaccaggcggtcctgatctagtcaggtctgtgcttttaaagttttcatggaatatagggcatgtactacctatttagccacagaacccaccatgccataggacagtacccagcactgaatcttttcccacatgcccctgatggatgtaagtttgcaaccctgcttagtcttagagagttgttaaagagttgataccaggcattgattttatccagtccctctggagactggcaggagaggctattgtatgtagaagggatgtgagactataggaggaaagggcagctaaaaaaactaccacaattaaatgaaaatgatagaaattatgtttgcaaggatgtagactagctaaaaaaagtcatacattataacttcaggaattgtcaattggtataaccactttgcaaaactttttagcaatatttattaagctaaacatctgcagaccctatgacttaataattttatttccagacatatgcccaacaacgctgtgtacatgtgtgtacacaaagtcatgtacatgtgtgtatataaagtcacgtacaagactacacagcagcactattcataataacttcaaactggatactgcccaaatagagagtaggtggtggataaatatatttttgtatgttacatataacctgagcacggtataattatgaacaacaatatggttaaatcttataacatagtattaagtgaaggaagacaaactgaaaaggtcacatgctgaatgaatctgcttatacaaggtacaaaaacaggcaagactgaaagttgctcttaaatgatgattacctttggacaggcaccagtgtttgtctggaagagggcaacaagagggcttctgggaagctgataatgttctatttcttaatttgaaaactggtttcatgcatgtgttcagtttgtaaaaaagtattgagctggaataagtgtgtttatgatatacgtatctttctgaatatacttcaattaaaaagttttacaaatttaaaaaataagttaaaggtcatcacaaataatattattgcagtagacagtgagaattaatgagacctgtaccagggaaataagtgttgtatttactcatttgtttatctagtcattcattcaatttttattaagagtctgttatggatcaaacgttctactaggtgttgagcataccaaagctacacggagaagagagatattaaacaatcaacctctcaactaaataatttcaggaagaaaaaggcaattaataagcaaagcaaggtgatgagatacagcagaaatggatagcagtaggggatgttggagaggagaggctactttagacaaattagcaactgtgtttcccccatctcaggctgctaggactaagcacttctgcacagttagtggtgttaaaactcctaggattcttgttccaatgccagcagatttttcgtcttgctgatggtaaagcaggattttgataaagcttccttacaaagggtgtcacatgcaataatgtgtcatgatcaacatgtcacagcacacagcaccaggctggtacgatctgacgatccagggctcataataccattattgggcactgggaagtgtattttgctgtgtcttgcaaaatgctcaaagaaacactgtctaccactccttgacctacgttttataggatccttagttgtctgcctccaaagtggaaaatattccatgggtaccctgatagcatatttaacatgcctttcatctcaacatttgttttctggattgttgctccatccaactccctggcacttctgaacataattggtattcctttgttaccaagactttttccacaaactttacttttgaaatatttcttaaaactttttttaatttttaatattcaaataatttcagatctcacagttagtccaaacatcccactaaatctgatatgagttagagagctcattggaagaaaagggatagaacatatattttttaagaaggaccaacattaaaattgaaggtttttgtcttctattaatatcactggagcctctaaaaataaatgtgctatataaatgtaaaattctcatcacaatttttcatggcagaacatgtagtaaagacaacttgaaaatatctcagctttacggaaggagttattgccaggtttgattttgtttaatcaacactggccctccagtctatccttgcatctccaaagcctacatatttggaggacccaccttagatactaacacttgtagaaaacctttcctgataacctaagccaagagtgctttctgccagctaaactgctgtacctgttatttatacctttctcacaatcaactgtgtggtgacgtgtctagctctctacctggctgctgggtgtgagtgtcttgatgtgtttaagttatctctgcatcttgcacaaccacagcatcatcaccgtcatcatcaccttcaccagaaatacccactgagcacctaccctttgtcaggacttagctcagtgctttaatagccttatcttatttaattctccaaacaaccttattactactcactttttacagatgaagatatgggagcatggagaggctaaataacttcttcagtttcctcagtgttagaactaaaactccaggaatatggctttagcatagactcatacctgtggtgccacggtgcttcttacctagcaaaaacgaggcatcatggaagttcataaacacccgttcaatacattggccctacggcatgagagtggctgtgaattagtttgggcagaaaaacacaggaagtgagtcgagcctcacggatgttttgtggtgagtttgagaaacattgagggtcttcatttcaagatgaccagtgacctgtttgcttaactggggtctgtgacaaatactctaagcacctcatgtttcccgtgagcatgacaccttcaatcaaatgttcacaaagccaccgtcacatgtaatgcccacccagctgctggtagaattccccgagtggtacactgtgaagacaggtgggattctcgggatgaaaaggatgcacacttaagcagttggcagagatttgctttctccattccctttattaactcccattgacttccattgtaaaaatgaagatgcattcccatgggataaaacacttggcctcaccactagacaaaaatgacctgtacgaaggaaacaaacccctttcaatcagctgtttaaaggaaaaatgataatggatgaaagaagttgaaggaataatgatcatgatctttagaaagcaatgctaaactacataaagcagaggcagaaaaaaaacataccttttagaaaaaaaaatgcggagacagtaggtccatgaaaagaattgaagcaaacatggacgttcatttattcatttactttttctactcatttattcacttattcagcacatctcactggtttgtgctgtttgcgctctgttctacatagaggagagaaggacaaatgagaagatactcaagaagtgagacacaggagtccctgtgttcgggtggatatgaaggtgttacagcacagtagttatgacgcagattttagcatttgggaaccagcatagcacagacttgggactggaatcctgttctccagcttatcagctgttgcctttagcaaggcatctgacctcactccacctcagtttccctgcttgccatgtaggaaagagtttctgacatgaaaaagttgttataaggatttgtatttgtatatcacttagaactaaaaagcaaatgctgttttaccatgtgttatctgaatgagttggagcaaaattagtttattcaactgtaaaataggtaacttgtacatctcaggataatgaaagttatacacatacatatatatatataaatatgtcacatacacacacacacactgaaggaattcagaacatgccaccccaaaatatgttgccctggcatattgactattctgagttaaaggaacttgaaaaaccgcagatccaagaaggacactctgatcttccttccatctctcaaaagagagagatgaaggccggacgtggtggttcatgcctgtaatcccagtactttgagaggccaaggcgggcggatcacctgaggccgggagttcgagaccagccagaccaacatggagaaaccccatctctactaaaaatacaaaagtagccgggcgtggtggcacatgcctgtaatctcagctactcaggaggctgaaacaggagaatcacttgaacctgggaggcagaggttgtgatgagccgagattgcaccattgtaccgttgcactccagcctgggcaacaagagtgaaactccgtctcaaaaaaaaaaaaaaaaaaaaaaaaaagaaacagttctctaatttgagaactgtccccgctataccaagagaaaggaaacattcttatcatggaggacaggaaattgagaccaagagaattctgtgcaaacagatccttgttaaaataagtcttatcttcctttagccttgccaccattgccctttttttgttcaacctagtataagagcgtttaggttttgccaggtctttgagtcttcatttcctaatgaggtctcctgtgtcttataaaatttatatttaaaattggtatgcttttatcctgttaatctgtcttaagccaaattaattctcaggcccagccagagaccctaagacagcagaggcaacaaagttttgcttcccctacaatatataccatatataaacacacatacatacagagatgtgtatgtgtatgagggtgtgtgtgtttgtgtgtgtgtgtgtgtaaaatacattatataaatacagtcattggccacctaatgatgtttcagtcaacaacagactacatatatgacagtggtcccacaagattataatgaagctgttattgtccctggacagggggacagtaattttgttgatctcaacccggtgtagggctaggctaatgtgggtgtttgtatcttggggtttttttttgtttttttttttaatttgagacagagtcttgctctgttgtccaggctggagtgcagtggcaccatctcggctcactgcaacttctgcctcctgggctcaagcaattctcctgcttcagcctcctgagtagctgggattacaggcaggcaccaccacgcctggctaatttttatatttttgggagagacagggtttcaccatgttgatcaggctggcctcaaactcctgacctcgtgatccacctgccttggcctcccaaagtgctgggattacaggcatgagccaccacgcctggcctgtattttactttttaatgaaaacgtttaaaatttttttaaagttaatagaaaaaaatacaaagatctaaataaagtatttttgtacggctgtacaatcggtttgtgttttaagctaagtgttcttacaaaaagtttataaaagttacagtaagctaaggttaatttattattgaagaaaaaaatatgattgtatgaatttagtgtagcctaagtgtttggtgtttataaagtgtatactctgcacagtcatgtccttgtctttcacattcagtcaccactcactcactcactcactcagagcaacttccagtccagtaggctccttttatgattagtgctttatacaggtgtaccattttttatcttttatacgatatttttactgtaccttttctatgtttatatatgcttagatacatgaatacgtaccattgtgttacaattgcctacactattcaggacagaaagatgctgcagagatttttaggctaggagcaataggcaatgccatatggcctggcatgtagtaagctctgccacctaggtttgtgtaaatacactccatgatgttcacacaatgatgcagtcacctaatgacgcatttctcagaacatttccccatcgttaagcaacacataactgcatgtaaacggcttgacgcagcatcttacacccagcaaatactcaagtggctaaatggtaagctctaagacaagctctatctatatacctatgtatgtatctatctaatttatataattttattttattaatatttagtgggaaatgagagaggagataacataatttttacacattaaaaaaaatttgtgctaagcccctattatgtacaaggcactgggaattcgataatgaaaatgacaagtgtggccactgacctcaagggtacttatagtcagtctttctggactgggcagatgaaatacagatatgttcagatacagaagactgggggaaaagaaacttggtggaaaaatgtattaggtcagttaggggcatatgagggtaagaggaggagttgacaggaacatactcaggtttgaaatttagagtgggggaattggatttattatagatttggaggttatcaggagttggatggtggaagatgagatcacccagattgaacaagtgtagtgagacgcaattctagcttaaaaacagaactcttgataactcaaccattttaaaatgcaaataaagaaaaggatccaatgatgatactgagggggaaaaaaagttgaaaaaataacagatccaagattctacaaaaaatacagacagaagggcagaataatcagggtcatgtggttgcagcctaggaaagcaaagacatttatcccagcagccaagagagtcacacaggttttgttacatacttgattttacagcaatttaaaaagccagactttgagacacttcctatatcacgaggctcttgctgtccagcagaatctcatttcctgaaatttgtgcacatttggctcctaataactcctcattttatagtttacaaagagctctctcacatcttgactaggcctcaccactgagaatcaggcaaggtctgatcattatctccacttacagatgaggaggaaatgggttgagagaggcaaaagcatgtgtctgaggtcttgcagatttattgacatcctgcaacacactcgctattctctccctgaccctggccttggagaattgtgtcttctgaaatatattctcagaaattatgctctataccggatcttagaggggcattttggatccacataacccatgacatatggaacattaacttccttaaatctttttggaagtgaataaatagcaaaatgagtagggaattaaaacagatattggggcattttcacagtgatggagagacaaaggcagataaacacatccctttgtgtcattacatcccatcctctcctcctaccccccaaagacagagcaattaggctgagtttccagggattgcctggcctgtgtaggtgctgcgcaccctccatccagtgacccagtacaaatgccgtctctcgcagcttcacagaccgctgctgctgacttaggcctcggctctgactctggttcccttcctcctgcctttcagtcagattttcccatttccgaagtcaacagcttccccaaagcaatgggacacaggacgtcataactcagacgccaaacagcaggagccaggagggagggaagaaaggaacacaatggaaatgggtctgcagaggctgcgcagaaggaggactggagtgggagtctaggggagattaaagcaagtgcgtgacgctgagcattgttgggcacaaaagccactgtgtttggtgtccagttgatatctcatgtttaaagtccggggtgtatgcacagaaggtgggatttagaatctggacaatcagactagggggttggaggagctaaaaccagccccttcctggacagagatggtccagaggtgggcagaggcaggctccaagaggacactggagtgctgcccagtaaactgaggcctaagcacttgtgaatgaatggagcccagaaaaaaggtagcagatgggggaggggagcagtttcaggctgcacaccaatgcctcgatgcaaaagacaccaaggacctggcagcagactcctttctctttccacaacctggtgggcctgtgaggttgctcaggttaccttgtatctagtagcagccaggtctcagctggaagaagccacaagtgaggaggcagggcctcagagaagagcaggggccagtcattcgaggcacccaaagatgtcctggaagggagctggaggatctttctagaactcccaattcaatgtgttgaggtgtctcagtcctgtttcacaggacttttaaactaatatggcagacttttggctgattgtaactgagtactttaaattatgtagatgactatattttttttcacttaaaaggtcagttcttatataacttgcctcattcttttcaaaaaatattttcatatacccactaaatagaatatatagaaatgtatgcataaagcatatatacacacacaaagaaagacaatcttcatatagaaaaaatataatacgcattcttaagtgtactcagcacccagatccagaaatagaacataccagcaccctagaagtcctgatcatacttaactcttaatttaaaaaaaattatctcagcaactgccaaccccaagaaatacctttccaatttaggttgaaaacaaataaggaactgcaatacagtacgtgggttttcactctgtggcacactttccatacagatctattctgcaaagggaattacacctcatctccagctcacccaagaaagcccatggagattcacgctgattacacaaaacggatccatagcattagcagtggctgttctgctccatggtcgttcagaagtcagccctgcgtctgactgaatggcctgagtcctttagtataattactgtcgtgtacatcttccttccaagctctgcagcagcagccagcgtggaaggggagatttccacaaccagcacttatttctgtccatgcagtttccagtggaatacttagcagcatttcctccacagggcagggcaccttggaattactgtctgcttccagggagttttgagctcagagtctctgctggggattgggatgggacagggagggtgtacaaacattcctctgaagtagtgcacaagattttcagcatttttcgagggagcgtctcaaagttacacaacatccccacaccctgcccttccccctaaaaggttaagaacctctttacttgactatgagttatctgagggcagaggcattgattaatcttcttcaacctgtatccacagtgagatttttttttctgtattaccagccatcagcctgtgtaactgaaaaaagctaggaatttggggtcagacacactgtcatcctccgtgtaactgagtaaatttttaaactctctgagccctcatttttttcatcagtagagtaactataataatgcccactacactgtaacattatatatgtctgccagagtgcttggctcattaaagaatttctgcaaagtccagctatcctatctccctacctctctgataaatccagagcaagctgagatgggaagaaaggttgagctcacagttatccggatgtttcagactcacaaccaatatgaaattgaggctggccacgggatggcaactccactcagcatagccacggagtagcagtgagagcactgtgtcccttgatgttcagcccataactcttcaaaaggccccttcttggtagccctgatcagttctggtgtgcagtctgtcaagttctggattgccattttagcacggcacccatgttttgagagcaggagcttggtctgattccaccactgcacaaggctaggcacactgcaggtgttggataaatgccagctgaatttacagattttaataatgaagtctacggctcaatttaactagaaattataagtaaaatagcatgttaaaccctatatagttctttcgggcccccagaggaaaggacaggtagctttcaacagactatcaaatggagagaaatgttaatctattccttaataatctccttatgtctttatatgcaaaaaactccccaataggtgtgtgtttcaggggaatcatcagaccctcctgctcaacgcctattgacttacaggtgctaaatacccagtaagttgctctctgttctacttaacaaccacctaattcatccactgttccagacttggaaagagatgattcttgtcctgaggttttctccaacagaaagggaagaaagtacatcagttaataattcttagtatttgatttagagtttcaagtctataaccatcaagatagcaattctaagaggcaaaaaggcaaaaaaaagtagtctgtattgaaagcaattataatggccacaataatatcaataacatctaccgtggatgaacgcatttgaaatgcagagtaaaggactaatcatgaatcatctcattgtattttctcaagaaggaagtaaaataagcatgactttatttccacttctcaaatgtggaaacttgatggagagaggtcaagtgacttggccaaggacacagttacaaagtcaaaagtccagcctagatctacctgattctacagcctctgctgagaactgaaaccaaagtcaggcaccttgtcatacatcaatatcattaatggtgccaggagtagactccattattctgaattcctaaatccaaattttacacattgagaggatctgtagatttgcttctacagctgtatagattatccaattctgatttttaagtcaaatcacacaatggctgggcaggcttccccaaaccctggcaaagttttcattgcccacaagatggcgttgaggggtgaatgaaaaacctccaggcatggatgtcctatgtgcaccattccatcagaacataaatgcactggcattttccagcaagatctgttaacagttttggaccaaggaaggagaaggggcctcgttagatctatcactatccagtcatgtaccacgtcctgcattaacgctttgcatctgtgactccaaaacaaagtctcagaaactccctggtaggtgtggcaagtacgtgacaatatgctaaactaaactcaattggtttaacctccagttccttaggagtcctgggcataccttccttacttgaaattacacgtaaccttggttggcacacagtaggtgcccaatccgctgaagaattgatgaatgatgtttcattcaataccttgaatgctggccttctctggataaggattggctaaattttacatccagaggttaatgaagctgtcattgagagttgaggttctgaggaagaaagactaaggtctgctggaaagacacctggaccgtgagaagcccaggtgtgcaactctagttctgagccttagaacctttgaacaaatcactgagtctcaaggtcctcatctttaaaatattcatgtttgccctgcatagtttctattgaaataatcaaatatgctaaggaatgaaaattgctgtacagaaaaatgtcactattccaaatgtaaaattctatactcaggaagggagcagttattgccttttagtaggtgacactaaagttggtcatgcattaagaatctggagtcagagctgaatctcagcgacaccatttactagtagtgtgaccttaggtaaataatgtaactctatgacccacagtttctacctctataaaatgggggtaagaatagtataagcttcttggagattaggacagaggtaaaaataaagtatttatcaaaatgcctagcacatagttaccatcaaaatggtactaatcataatattaatattatgtgtacaacttttaatttatgtatatcatgagttatgatattttaaacatagctcttactgactcccatgagccaattgcatgcatgtcttttcaactttgtgttcagcagcaatcacattggcagcttgaaaatggctgtagtaggagttatttacactactactatagttgtgtagtataattgataaatgctacaaatcagaattgttgtttattgttgttttcattttcttccagagaatcaatttatcagtatcaaccaggcgtggtggctcctgcctgtaatcccagcgctttgggaggccggggcaggtggatcacttgaggtcaggagtttgagaccagcctggccaacatggcaaaaccccgtctctactaaaaatacaaaaattagccgagcgtagtggcgcatgcctgtaatcccagctacttgggaggctgaggcaaaagaatcactggaacccaggaggcagaggttgcagcgagctgaggtggcaccactgcactccagcctgggcgacagagagagactccatctaaaaaaaaaaaaaaaaaaaattaccagtatccttttggttatgcatattgaatgtgtcttagtttaggtctcctagaagcatttcctaagctgagattcatatgtaattgagctattgaaggagtgcccccaaataaaacttgcaagtgtgtgagggaagccttatagggcagaggaagaaaccgggcaaaggtgagggtgcagctgaagtctagtctcagcctcattccacaggcagctctggagcctgcgtggaaccacagagttcccaccttgaggcaagggtgccaaacttttctgcccttgtgttagttggccattggctactgacagacttctggagagaatgcagcttcccaggccattctgggtggcacagctcctgatagcaagtaattctctgaagggtccagctgtgagtcaagaacatctagcactgatgagacatggatgcaccagcccagcaaagggcagctgagcagggcaccaacagcacctactacagtatggaaacagattgtcatactagacatttgaactagaatagatttgggaagtcacctctcctatgtgtgtaatccaatacagaagagttgcttattcaatcagcaaatatttatttagtgtaaactacattcctagtaatgggattggtactggagatgcagggctgaatgcaatcagatgtggagtcccggcactggaggagtttacattccagctatggagacagacattaaccaaatgctcccacaaataaacacacatttacaactgtgatggttactgtgaaagggacaggaaacatagtactcttctgtcaagacaagggtttgatagacagggaggccccagagagcttccctaaaaaagtgacatctgaactgagatctgaaacatgaactcactaggtgtgggagtaggatgaactagaagtgggaggagctgacagtagacaggtaagtgaaccttcccttggactcatctccaggacaagcttgcgtatggagatttgtccctgaggcccaaggagtgggatggctcctggagaccacgggggtggggaaatgaggaagcaaggagagttatctttactcttctgagaacagtacttagaaggcaggccaacccttttctatttctactaatattctagaattctctattttgaaaacaagactatttttatcctctgtcagtcctctgagcccaagccaagccatcgcatcccctgtgacttccaggtatatgaccagatggcctgaagtaactaaagaatcacaaaagaagtgaatatgccctgccccaccttaactgatgacattccaccacaaaagaagtgtaaatggccggtccttgccttaagtgatgacattatcttgtgaaagtccttttcctggctcatcctggctcaaaaacacccccactgagcaccttgtgacccccactcctgcccgccagagaacaaaccccctttgactgtaattttcctttacctacccaaatcctataaaatgtccccacccttatctcccttcgctgactctcttttcggactcagcccacctgcacccagatgaaataaacagccacgttgctcacacaaagcctgtttggtggtctcttcacacggacgtgcatgaaatttggtgccgtgactgggatcgggggacctcccttgggagatcaatcccctgtcctgctctttgctctgtgaaaaagatccacctatgacctcaggtcctcagaccgaccagcccaagaaacatctcaccaatttcaaatccggtaagcggcctctttttactctcttctccagcttccctcactatccctcaacctctttctcctttcaatcttggtgccacacttcaatctctcccttctcttaatttcaattcctttcattttctggtagagacaaaggagacacattttatccgtggacccaaaactctggcgtcggtcacggactgggaaggcagccttcccttggtgtttaatcattgcaggggcacctctctgattattcacccacgtttcaaaggtgtcagaccacgcagggatgcttgccttggtccttcacccttagcggcaagtcccgcttttctggggaaggggcaagtaccccaaccccttctctccttgtctctaccccttctctgcttttctgggggagggacaagtacccctcaaccccttctccttcacccttaatggcaagtcccgcttttctgggggaggggcaagtacccctcaaccccttctccttcacccttagtggcaagtcccgtgtttctagggggcaagaacccccaatcccttatttctgcaccccaacctcttatctctgtgccctaattccttatttccatgccccaaccctttctctgcttttctggagggcaagaaacccctaccgcttctccgtgtctctactcttttctctgggcttgcctccttcactatgggcaagtttccaccttccattcctccttcttctcccttagcctatattcttaagaacttaaaacctcttcaactctcacctgacctaaaatctaagcatcttattttcttctgcaatgccgcttgaccccaatacaaactcgacagtagttccaaatagctggaaaatggcactttcaatttttccatcctacaagatctaaataattcttgtagtaaaatgggcaaatggtctgaggtgcctgacatccaggcattcttttacacatcagtcccttcctagtctctgtgcccagtgcaactcgtcccaaatcttccttctttccctccctcctgtcccctcagtcccaaccccaagcgttgctgagtctttctaatcttccttttctacagacccatctgacctctcccctcctcgccaggccaagctaggtcccaattcttccttggcctctgctcctccaccctgtaatctttttatcgcctcccctcctcacacctggtccagcttacagtttcgttgtgtgactagccctcccccacctgcccagcaatttactcttaaaaaggtggctggagccaaaggcatagtcaaggttaatgctcctttttctttatcccaaatcagaagcctttaggctcttttttatcaaatataaaaacccagcccagttcatggctcgttcggcagcaaccctgagacactttacagccctagaccctaaaaggtcaaaaggccattttattctcaatatacattttattacccaatctgctcccgacattaaataaaactccaaaaattagaatctggccctcaaaccccacaacaggacttaattaacccatcttcaaggtgtacaataacaaaaaaaaaagttgcaattccttgcttccactgtgagacaaaccccagccacatctccagcacacaacaacttccaaacgcctgaactgcagtggccaggcgttcctccagaacctcctcccccaggaaattgctacaagtgccagaaatctgaccaccaggccaaggaatgcctgcagcccaggattcctcctaagcagtgtcccatctgtgtgggaccccactggaaatcggactgttcaactcacctggcagccactcccagagcccctggaactctggcccaaggctctctgactgactccttcttggcttagcagctgaagactgatgctgcctgattgcctcggaagccccgtagaccatcacggacgccgagcttcaggtaactctcacagtggagggtaagtccatccccttcttaatcaatatggaggctacccactccacattaccttcttaagggcctgtttcccttgcctccataactgttgtgggtattgacggccaggcttctaaacttgttaaaactccccaactctggtgccaacttagacaatactcttttatgcactcttttttagttatccccacctgcccaggtcccttattaggccgagatattttaaccaaattatctgcttccctgactattcctggactatagccgcatctcattgctgcccttcttcccaatccaaagcctcctatgcgtcctcctcttgtattgccccaccttaacccacaagtataagatacctctactccctccttggcgatggttcacgcaccccttaccatctcattaaaacctaatcacccttaccccactcaatgccaatatcccatcccacagcacgctttaaaaggattaaagcctgttatcactcgcctgctacagcatgggcttctaaaacctataaactctcctttcccttcccccattttacctgtcctaaaaccagacaaggcttacaagttagttcagaatctgcgccttatcaaccaaattgttttgcctatccaccctgtggtgccaaacccatacactctcctatcctcaatacctccttctactacccattattctgttctggatctcaaacatgctttctttactattcctttgcacccttcatcccagcctctctttgccttcacttagactgaccctgacacccattaggctcagcaaattacctgggctgtactgccgcaaggcttcacagacagccgccattacttcagttaagcccaaatttcatcctcatctgttacctatctcggcataattctcataaaaacacacgtgctctccctgctgatcgtgtccgattaatctcccaaacctcaatcccttacaaaagaacaactcctttccttcctaggcatggttagtgcggtcagaattcttacacaagagccaggaccgcaccgtgtagcctttctgtccaaacaacttgaccttactgttttagcctggccctcatgtctgcgtgcagcagctgccgctgctttaatactgttagaggccctaaaaatcacaaactatgctcaactcactctctacatttctcataacttccaaaatctattttcttcctcatatctgacgcatatactttctgctccccggctctttcacaattaccattgttcctggcccggactttcacattattcctgataccacacctgacccccatgactgtatctctctgatccacctgatattcacaccatttccccatatttccttctttactgttcctcaccctgatcacgcttgatttattgatggcagttccaccaggcctaatcgccacacaccagcaaaggcaggctatgctatagtacaagccactagcccacctctcaggacctctcatttcctttccatcgtggaaatctgtcctcaaggaaataacttctcagtgttccatctgctattctactactactcagggattattcaggccccctcccttccctacacatcaagcccaaggatttgccccccacccaggactggcaaattagctttactcaacatgtcctgagtcaggaaactaaaatacctcttagtctaaatagacactttcactgaataagtaaaggcctttcctacagggtctgagaaggccaccgcagtcatttcttcccttctgtcagacataattcctcagtttagccttcccacctgtatacagtctgataacagactagcctttattagtcaaatcagccaagcagtttttcaggttcttagtattcagtgaaacctttatatcccttacggtcctccatcttcaagaaaagtagaacggactaaaggtcttttaaaaacacacctcaccaagctcagccaccaacttaaaaaggactggacaatacttttaccactttcccttctcagaagtcaggcctgtcctcggagtgctacagggtacagcccacttaagctcctgtatagacgctcctttttattaggccccagtctcattccagacaccagaccaacttagactgtgcccccaaaaaacttgtcatccctactatcttctgtctagtcatactcctattcaccgttctcaactactcatacatgccctgctcttgtttacactgccggtttacactgtttttccaagccataacagctgatatctcctggtgctatccccaaactgccactcttaactcttgaagtaaataaataatctttgctggcaggactatgctgaatctccttaggcactctctaatcagatatcctgagtcgtcccaattcttagaccttttatacctgtttttctccttctgttattccatttagttgttcaattcatataaaaccatatccaggccatcaccaatcattctatacgacaaatgtttcttctaacatccccacaacatcaccccttaccacaagacctcccttcagcttaatctctcccactctaggttctcacgccgcccctaatcccgcttgaagcagccctgagaaacattgcccattctgtctccataccaccccccaaaaattttcgccgccccaacacttcaacactattttgttttatttttcttattaatataagaaggcaggaatgtcaggcctctgagcccaagccaagccatcgcatcccctgtgacttccaggtatacgaccagatggcctgaagtaactgaagaatcacaaaagaagtgaatatgccctgccccaccttaactgatgacattccaccacaaaagaagtgtaaatggccggtccttgccttaagtgatgacattatcttgtgaaagtccttttcctggctcatcctggctcaaaaacacccccactgagcaccttgtgacccccactcctgcccgccagagaacaaacctcctttgactgtaattttcctttacctacccaaatcctataaaacagccccacccttatctcccttcactgactctcttttcggactcagcccacctgcacccaggtgaaataaacagccatgttgctcacacaaagcctgtttggtggtctcttcacacggacgcgcatgaaatcttcatattttctcagattggttattttctgtttttctttgatgtttagaaaagtgccttttgaaaatccctgcctgatttagcccaagaaaagtcggggtggggggtgtccttactaagtcctaaagttaaaagtcaggaggatgacagatctctatatttacatgggtgtgtttactgcacatatatgtgtgtgagcctgtgagcacatgtgcatgcatgtctgtgtgtgtgtgtgcatgcatgtctgtgtgtgcatgtacatgcttgggtatgcatatgagagctgcatggatgcaagtgtgtgtagctggtgcttgtgtgtgcagtgtatgtgtgcgcgtgtgtgtcatgtgtctgctttagtgatcagggctgggaggtagagagtggaggtgggggagaagaaagcaagcatgcacagggcaagtcctggagggaggaggaggaagggaagtgctcattgctgctgctcagcccattattaaagagaaacaacattcccagcaggaggcagaagggcaataaaaccagtggctccacaatttatgatgctaactgagattccatagtttgaaacaagactatcccctggagcatcaaggtcaacaagccagcaatgccctggcttccaaagagctcccccgtgcccacctattaatcagcccattgctgaaagtgcaccaatgagctctgctctggaaacatcattaataagcagggacaggccagattgctaaaaattccaggataagggcagaaaggcatggaaaaaaatatttatatacacatatgtgtgtgtttgcatatggggtgtagcctattatgtatattgggccatccattacaggggtcatatataagtgtgtctcttcattttccatatattttatattatacgagaaatgttcagcctttagaaccttgccagatggaattagagcaattgttcttctgccgagactttgggaaattaatgaggttcgcacgcagagccatgagaaaatagaattttttttaaagaaggaaagaaagaaaggaaagaaagtgccccgtttccaaaaatacagcagccacaatcccagagagagctatccgtttagtggctaatcttgaggcccatcagttgccccagcttatcttttgggttattgcaattctgaatggagctttaatcagcttagcccagcctgggcgccacgcgcctgccggcaaagggcattttcctacagatcctctggaaaccgtctcctctgctcttaataaatggatcattctctctctgggtccatcctggaatgcagcgcttaactttcttttgtgttcaaggaaagaaaaagagcaattatagggaggaaacccatgcactctgaaccccaaattgaaggactgagcattttctttataccaaggcttcaatattgtctaggaggttggaccccaaattggaagtgtcattcccaaaaatgtgtttctgttttactgttctatcaacaaaacttttcctggattctctgtccctgtcagagaccaccctgaaaaaggactctgtgcaacttttgtcactctccaagccccctgggacaagcctttggccaacatggcgacctcccattctgatggctcccctacaatgcaagggggtgggacgagagcccagcgctgggtctttgcctcatcagatgagcaagctggtcccagatgaaaccactgctggcttgcctcctgctctgctccattctatgcctccagtttggaacaggaagggatttttgtcagcaatcatccccaaagggtgttttcctattgcttaacaggccccagaaccagaaatgctgtgcattttcccagctctttggctccctgcagccctgtcttctgtttggagctgtctcggagggaacacagaaaatttacaatatgctgtgtttgttctgaaacaacagaaaatggctctgaagcggagctttaagagactattcttgctagcaatgtagggaagggcatatatattcttttgtatatgcatgcattgagatgatatgtgggagattgtttaagctgccctttttttgagcatgtactgtataccagcagtatatgttaagcatttatatccatcatgcaatatctttgatgaaatggagactcaaaattttccaaggtccaagaactggtgagtgtaggagttggggtttttcaaccaggtctgtttgatccagagtgggttctgtgtccccctgagtcctgttccagggtcatcaaatgtcagaacttccaatagaaaaagataagctcactaaacagtgcccttttgcagatagacaattgatcttgtcaattactaagtagtagaaaggagaccagaacccaagtaatacagggatcttattctgtgtttctgtgtgtttaaaaaacgatgaagtggagtggggaggaaaggctccctccctctgcaccagtctttgcagagggtccttaccttcctcactgagtaaactcaaaaggcatctgctcaactaccagggctatgagtatgaattcattcattccattacccttaacacaccctgggcaagagtgatcacctgatggtgggaggacagcaattgaaggaccaaaggcagcctcagtccaagaaccagtgtcagtgctgagcctgagagcaagtgcctcatcataagagttcctgagagggctaaggccggacatggtggctcatgcctgtaatcccagcactttgggaggctgaagagggcggatcatgagttcaggagatcaagatcatcctggccaacatggtgaaaccctgtctctactaaaaatacaaaaattagctgggtgtggtggtgtgcgcctgtagtcccagctactcgggaggctgaggcacgagaatcacttgaacctgggaggcggaggttgcagtgagccgagatcaggccactgcactccagcctgggtgacagagtgagactccatctcaaagttaaaaaaaaaaaagagttcctgagacggctgggtactctgcacacacaggcaaactgagtgcagcttcctaagctagggtccccaggaatggattctgactcacggactctccagagagagggagacgctaagctgcagagccaagggaggtggggaggacagcagctgctattgttgtttctctctcgaccttattaaggcaagaggaggacccattgtgctcctaatgattgctgagatatgaggtatgttcactgagaggaagtagtttggttttaattaaaaacacagaccttaagatgagctagagaaggaaaaattcagggccaaccttcaaagcagcttttgggaaactgaatttgagttccacctaagtttcatgaccttgaatgagttatgtccttatgctttggttttgccattattgtgactggcatgtaagaatttttgttgatctacattgttacaaatatgggatttttcaacccagctctaagcagaggctttgcattccatggtatcttcatttattcacattgcaccttaaaagaaagagaaaggaaaccgatagtcattgataatttactctgtaccaggtactatattaatccagtttcatcctcatcttacatagtttcagccccattgatagatgagtggcagaaaggtttcaaatgttacctgatctcacacagctttaaactgaagaattgctgttctgatccaagtctgtcgaatctttgtctgtactcaaactgtctctgatgcttaacatcatgcttacacatttttacattctcaacaaaaaccaagggatgattctttccatgctccttggtactcagcttttcttgccctatatcatttccatttgcaaatgggccctgcttgcgcatttggaacatttatttgcaaattaacattttcacatccaactgttcacccacctctatgtacttaagtcaaaaagactgcaggacacttacgttatctccttctcacatgaagctaatgcctgaaatccaacttgtccttgggcctatagctaagtccatggagtagaggaggtgccagtgatggtggcttggtgcagcaaatgggcatgcctcaccccacgttcccaatccacttcccctcctgacttcccatttaggagtcaataggatgatattctatcattagctgaggcttcagggccagggttatgtcagacctgccctggctgggcctgggtctcgcaagctgcccagatgatcccagggtccccaatgggggtagcttagtaaataccacaattcagagatgtctcaaattgtggaagggaaaattaactcagtggctgtatatcaaaaggcaagtggccattcatcaataaaaggcattagttacttagcctttcaagaaaaacgagccaccaatacctacaagagagaagcctaagaacaaataacctctaagtccaaatggggcacttcatcatccagcttttccctctacctgtagatttctgattggcctctctaccacttttattgcctcaactcaaacttattttcatgtgatggagagtcaaggcttcagggtttcagggccatgtgtctattactttactgtttactgagagataacagctgaaagaactcttgcatttttagaattggatttctttttttgttttttctttcataacagcaggcttctgctctgtttggctctatctggttgtgtctggtcatgctctgtcctctgcagtaacttccctgctttagttctccttctcctttccggagccagtcccttccagcttctcctctggttattctagtggagccccatgatgtctgttccagctgtttataattacctccctcaggctgcttggggtgagtgactcagcactctgccttgttttttgtttctttcctttttttttttttttttttaagaagccagatatttgtttaacatagtccatccaatatcacagccactaaatgctcatttctggttcccagatctaaacagcacctacagttctcaagtcactttgtataaataggttagattttgaaagtagaagtaactggacctgaattccacctccagccttttgtgcctgtctcttagcctctctgagtctgttttctcatctctaaataggggccatggcatgtgttcacaaagttattttggagataaagtgagacaatgaacagaaaaggccgaatgcagtgctcacccactatttttttttctccaaacataagcatattatttctcttttgtttcagatatccacttaaaaattacatcttataacttattccttctaatcgcctcttgtatgctcccacttctcttccatttctattactttactcctattaaatcaaggtcataatgcttatttctgaacatgtgcagtaatgcccaagtggttttttagcttctgatctttgactttttgacatcaaattaatcttctaaattgtacattcttttcttttctttttttttagacagagtctcactctgtcacccaggctgaagtgcagtggcacgatctcggctcactgcaacctctgcctgccagttcaagcaattctcccacctcagcctcccaaatagctgggactacaggcatgcaccgccaccacacctggctcagtttttgtattttttgttagagatggattttcgccatgttggccagactggtctcaaactcctgacctcaagtaatctgcccgccttggcctcccaaagtgctaggattacaggcatgaaccaccaccacaccgggcttaattgtacattctatccctgctccactatcagtacctagccttccctggttgctttcagctgcaggtctgagttttgcccctgtggattcaacactaccttccctgtcctctgtgcgagttttgacaaacgcaggggatctcctcagatttatccatttggcagataattaactatctatcacccactaagtgccaattgctgttaaggatcttgaggtcagacatgagtaagacacaacatatttcctcaacataaggttgcctcatggctaagcacatctaagtcactctggcaaaaactctccattgccacgaagactttactccatgtccatcctaaacaaaccagtctcagcctcaccagacagtgagctctcaaatgaattttgcactcctaggccttgcttttactgctacagcatgcctttattcattcggcagataattaactattacctactaagtgccaattgctgttaaggatcttgaggtcagacacgaataagacacaacatatatcctttaaagaattataagatcacgccaggcacggtggctcatgcttgtaatcccaggactttgagaggctgaggcaggcagatcacctgaggtcaggagttcaagaccagcctggccaacatggcaaaaacccatctctactaaaaaatacaaaaattagccaggcgtggtagtgggcacctgtaatcccagctactagggaggctgaggcagaaagaattgcttcaacccgggaggcggaggttgcagtgagccaagattatgccactgcactccatcactccagcctgggtgacagagtgagactccgtctgaaaaaaaaaaagaaaagaaaagaaacaaaaaaaagaattataacgtcagtgggagaaataaattccttgataagagctaggatgacgagatatacaagttcttgtgcttcttctgccagttagaagaatcttcctaattctcactcattctttcattcaagtgattttttttgtattttgttgttgttgttgttgttttgttttttgtttcttttgagcacctcagataatataggcattgaggatgtagtaataaaaacacaaacatggtcttcattttcacagagcttacagtctagtgggatataaagataacacatgattaaatatgtaattgcaacttgtgagaagttaattcatcaattcgacagatatttattgagtgccaacaatgtcccaggcactgttctaaatactgtatatacagtaacaaagctacagacctttcctgacttcatagatcttctacacagcaatcaagaaacaagataaaaaggtaacacatattacaggttactggtaaatgctaaggagaaaaaacataaaacaggaaatagggataataaaacatcatggggagaaaggggtttttacattttgaatgaggtggtcaaggaatgcctcccacgtaaatgacttttgaaagagaaccttgaaggagtgaaggagcaaggcatgaggatatctgggaaaagagcagtcccggaaaagggagtggcaagtggaaaggtatggaagtgggagtctatctgggtaaagaaaaatacagcccagtaacaaagaagagcaaggggtgtctactgcagtgttcagccaaggcctctgtaaagatacacccttaatctgaggtgtaaaggctgaggcaggtgtccacctgggttatatgagtgtgtgctccattttggatttctttttctcactccagatgcttccagaggctaaaacttatttctgagaaccagcccactccaatgacagccggccccttccagctgcctccttccaggggcctccaacctgcaccctgctccaaattaggatgataccccattgttatcacagcttggagattcctgatatctctgctcacactcccactcccacaatgccccactacagggatgagactaagctggaacctcttggaattctctacatccatttggacaactggaacccctccctctaccaacagccagttttccaactgggcaagtttcctccatatttatctcagtgcctcttcctcttccagaagcctcctgtccctgaggtcccagcatgccttgcagctagtcatggccaagttctgacatgttcacacttccccgaaaaagaaaaaatcagcagtatagcttctggagacttgattatttatggggcttcagtctacttggaaagcctacaaagaaaaacgacaaaggaatttgagttgtgatgagttatgttcaattctcctttgccatttactagctgtaagtctccaggaaagttaacttcactgagcttcagttttctcatttgtaaactgggaattcctttcctaccttaaagcttttgaaagaatcaataaaataaattaattgaagtacccgaaacataagtgtcccaatgaacgtttgttaaatctgaaacttccatgtcctctttggtttatgccaagtgccagcaaactactgtgtataggctgaatccaacccatggcttgtttttcataaacaaagctttattggaacatggccacaccattaatgtacatattgtcaaaaaatgctgattgccacagcagcagagttgagtagttgccacagagaccatatggcctcaaagcctaaaatatttactatcttgcactgtatagagaagatatgcaaatccctagtttataccatcatgggacactagaatattgtggttgagtgcaggagctggagtcaggcttcctgagtttagatgcacttttaccacttactaactatggaattcagagcaagttatttgatttatctatacctttgttttcacttctgtaaaaagggaatactagtttcttacattaagttgatgaaataattaaatgagccaatctagtgaagcatccagcacactgttaggcaaatggttagggttaatcaatataatggttattattgtgaatattatataatgttattacatatgctatccaagcactctctccattaactgggactatggatggcttttaaaatcaacctgaaaaccaaggttcctgactaaaatggcatttggcatataaacatccctccaaggatgtttatatgccaaggatcagggctcaaggatctgaacccaccttcatctacttttccttatggccacatccctccttctacttcctccctagaacctgcttggtaatgtggcctgaagattcaggctctctagatgagactttctctgtaatgcccttggcaggtgtgggcatgagtcaccgctgagcccagaccttttgctagtgaggatgcacctcccttcaatcatcattggcatgcactgcacaccttactgggccttgacattgaccagactgaaggaaggaggagcaacctctagtgactcctgtgagcagctgaggacttgttgagcagaacttacagcttaaagttaagggctaaagtgatagcccaggtggaaagaagaactaggtcagggcaggcaaggacagatgccctaatgtcttgggtgaggccacctcctggaaactagaaacccgagtgttgggtgcccaaatgttaaaacacaagagctcccgttaaataactctgactagacagatgtgagtcaataggtcaaaaaggatcaagagccatagagttgaatatactcagagccacttggcaagcaagaaaaaaaaaaagaaggctgtccaaggagaccttgtgtgtgtgcgcgcgtgcgcacatgtgtataaatatctatactctatagccagtgagggataagacagagcaacaacgcagcatgagtatgtttgattcctctacaatgcaagatttctaacatttataaaacagttgactctcattttccttttttaatgacacaatttcttaagtcaacataacctgacaaaatatgttcaactttggacgtgcataaaaagtcttacaaagttatacattcaatcaaacagatttacgtaccatttttaaggacaaaatagcagactcacgatatcaggttagccccagatcttctgagactcatgattcccctatcaataggacatacactttgaagcagctatcagtaatttttaaagaagacttcccatgtgaatcaaagggggttgattcagagccaagccacctgtagggagtgtagcacaagctgccaccacctcaccctgaatggataaagatattcatgcttcaaatctagggccccagcacacgccccaggtgtggcaatattgaggcgcaatagtcctgtcaaggaatgcaggtgactgttaaattggtttgctggagccaagaaattgtctttagcaaatgaggacacctccttgaaaaataaagacctcagccaaaagtgccaggaactctcttgctcccaaagtaaggtaattttctatcttaaatagccagtcctggccccagtgaactttgcaagcaggtaactagagcattctctaagaaaaaaaaaaattatttctcacactgacatgttctttctttcactttattatcattccaggtacagaactgagtataggggcaaatgagtctaaatgaaggaactttctagtccccaaacagggtgtggtatataataggctccccataaatttgcagaggctttctgattgactgtgttccactttgggcaaataaaccgaagccatttgttctctgcctgatgctacctctgcacactgttgtttcaagcatgtttctaaaatgttctctttgctgacaagaattgaatacatcaaaatgtaataacattctcgtagatatttcttttttgatgctttctaaacaaattacccattccaacatagagattaattagaaatatgctttcatttcagcttgtccgtgtgtctgtctgtctgacaggctagtagcatctttgcatcataccagccaaatccacaataaatctagtcatgcccaaaggtgggtttcaatgtgttcaggagcttgagctaggaaactcaggatgagcataatggaaggtggaaatactatggataatttagcaaacattttgggaaaacatcagattttccacaagtgtgggattcatcagcgttagagaaggaatgctgggtgcatcttcgcacatccacaatgcacacaatttgagactggcacttgccttctcttagcccatcaggctctgcaaacacacaggctgcagagagaggagagaatgtacaacctaaaaggagcttctcttcttttctcttgaaggcatttaaccccttggcacttcagagattttctgctttaggcctgaagctaaagatgaggataggttatgttgctgaacaaaatgagaaattcttctccccgagacagaaaggtgggctggaccgccttttgaggtttggtggtagttgctttgaggagatgctatctgaaagatcaactgcgcaagggttgatctatgaggcacatgaccgcagtgcttgcctgcctgaacaacatggtccctgcccagtttcttcttataggtgagtcaaatagattgctccaaattttgccatttgggagtaactgcatttatgactgatcgtgtcccccgaacaaagtcactgaggcaaacccagccccacagcatatctgccctggttataagcatttccctaccacctattgtaagctcagagcagtgctgggtgatttcacagggagccaccaaatatttcgagttctttatcttgatcctcctggcagcctttcacacaggtactgcagggaggtccttactaagtccagagctaggtgctggggatacagagatgagcaaaaaccaaggtgaagggctcagaatccagttaggggaatggacactcaccccaaaatcacatcaactaatgtgctattccacaatgactcaagtgcttggagggggaggaccagggtcctaggcaagttctgggaagcatagcacagtggttaaggttagagacatctgcccagagtccaatctcagctctgcctgctttgctatgagatctcagccaaatcgtttggtatctctgtgctttatgtgtaaaacaagactcctaatagcacctgcatcatgcggtcagtataggagtaagtgagatatttgcaaaacgcctagaatagtgcaatgtacgtatgcagctaaggaacatgcagctatggagatctgtgagggacaaaccattattcttattttggtgatgagaaactgaagttcaggtagatgatctgactaccccaaggtcatatactctgtgtacctgggcggctacctctgctgccccccaaatctggcaatccactccttcaccatgctgcctcctgtcttggcaaaggagcatgtcagggagccccagcctcgggcagggctcagctatcaccaccacagaagcagcctcactatcataacacatctctgtttaagaaacataaaccaccctttggcagcttctcaagtacatgtcagagccattaaagagctccctcccctcaccccacttttctgctttgactgtaagacctagccttacagggaaacacacaagagcttacccaacaggtttccccaacaaccatgccagagcaggcaggccccaaggagcccaggtctgggagggcccaccctcctggctgccaatgccccctctgacccgggcgccggcggcctccctctcctcctgtctgaacctgctgcctgggaagggctgatgtcactaatcttgcccttgtagctgcaggccatctcaggctcccaaacgcgattacccacaccaccagcttcacgcaggccctgcctccttccccctggcacctctccagctgtggctgagagcccagcttggtaaagggatggcctggcccagtggtgagtgtcccggccgggcaacttggcgcaagcctgacaagtagcatctgtgcttgtggaacctagcagcaagagctgggccaaagagctgagttccaaagctgggcctgcagaggacagaagagactctggaaatgagatgacaggatcagaacaggtcacaaatcttcagggagttattctaagaagaaatcacacccagttcccaaactgagtgtaaatgactcctcggaaaaccattaacggtgcccacctttccatttctcattagtagcctccttgcatcctggactatattggggacatatcatgttcacattctccactgatgggagctgaggccatactcagaatttcccaagggctcctgaggacagtaaaggtggtgagaaggcaggtgtttggctcagagttggcagaacaagcagggactccagagggcaatcagatttagtgcaataaaaaaaaaaaaaacattaaaatgaaagcagtaacaatagctcacatttgtcaagctcccactctatctcaggatctatgcaaaatactttatgcacatgagctcactgaaacctcacaaccactgggaaggtggatgttgatatttttcatcttacagatgaggaaacctgaatctaatggagaagaaattacttggctgaagctattcagatgctaagtggctgacctgaaattcaaaacctggtatgcctgaccccaggacagacccttccatgaataataggggccaggggtctctctgctcctcctcatgagctattgtgtcatggttttacaaacagcagaaactcatctttttgcttctaatccacctggatctctgatgctttaagtccaataccagataggtaagtttgacacatctttgggggttgcaactgaccaaatactagtcattgaccaggtaatgggcagcttagaagctctggagtcagatgtgaaaatgtttcccaactatgcaattaatagtctgggtgaacttgcttgtgttcatatacttctttgagccaaaggcttcttatctataaaccaggactaattatcattacattaataagcagggaagaggtggaggaaaaatggagtagacatttgaaatacaatggcagactagattgcaaactctagggaggcaggaagcaattacatcttgtccctgctgtacttagagcatccagttccctgcctgctagacactttgttcaataaattcttttgaagaatccattttacaaaattacttgcaagtttatgcaaatagacacattggttacatgtactaccaataagaaacaatccatatgaccatggatggagcatagctaaacaaacgtgagttatttcatgaaatcgaatgtgagatagtcatgaaaaggagcgagagaactctatctgtaatcatgtagagaggcaagcaggtatataaatagagtgaggggattgcagaacaatttgcatttatggcaaagtgcctaaaagagggtcaagagaagaatccatactagtctactaaaagtggttacttccacttgaaattaaaatttcaagaaggaatggtaagtggagaaggcggtgtggttgctggtgtaggaatatatttactttttgccctgtgcacttttgcattttttaatttgttttgacaacgaatctgatattttttgttacacaaaaatgcagtcaaaattattcactcattttaaataagtgaatagaagaataaacatctcgaatgccaaacataaaataggccccacaaatgttcatctttttctctcccttcccctaaagaatatttatcatgtatctgcatctctatgaccacaataagacattcaaacatatgcaaaatcttgctaaaattggttttgcccatcagtgtgtgtggccctgcaaaatctgatggcacccagctttgtggagtttcctggctatgtcttaaaaggacacatgacagacagcacagccatgggtttgctccaaaacagaaacagaaacttggatgctttgacaaaatttgaaaagggatgggtgggctcctgggatatctagcttagaaataattctcatcggaggctctgccatgacctcagtgccaaggaatattcattatcatggacctagtgtcttaccaaagagtcataactctaaattagaaaaccttaaggcccaagagaaaagtgaagaagggcagagtggtaagacaggatcatttccagagccagtgaacagtcattcaacatagccaggtccccttccaaaggaacacgcccttggttgactgcatttgtgtatctaattatcgagagaagtgggcaacttttgttttgagtccctactatctagacccagccatttccaaacagaccttgaacgtggtggaggggcagagaaagagcagaaaggtcagaaacaaacatttaggaaacacttactttgtttctggaaccactctagctgtctaacaaagaaggtctcctaggacttcgaaataccttaggaggtaaattagattacccccatgtcacaggtggcttagagaggttaagtgatgatcccacagggatttaatagcagagcctggaagaaaatttaggtttgtttgactccaaagcccatcttcacccaatacaacatacccaaagcaagggaacacacatacacaaacacacaactctttttttcactgtaactacttatacaactggactagattatagagggtgatgttttcttcccaatgtttcatactctctgggaagagtaaaagacacattggacagagcaagaatgtcacactgtcatacatcatgctgatattcacttcttagaaaatacttttgatattgtatatgaagtctcataaatattcattttcctaatctccttataccaatagatggtactgtttaactctctgtggagagctgtgaggcagacattggcaagggatgaatccccaatctctgctcctccccaaaagttgacagcctggtaggatggatatttgggttgcttttattttgtggtgaaatattgcagtaactattcctgctttgcttcttcttaggtactgtaggagtttaaaagttcctgaaagagcatcagctcaaacacatcaacttacaaatgaagaaaatgcagacagagaaacgaagttctttcttaatattacatagtaagtcagtggaagatcctggagtaacttatgctccatggctccctgactccaggtagtcaaatgtcttgacaaacagggaagcctactccatgtgttttgttaacagatttattgacttcaatgtataatttacataatattgaattcacttgttttaagtgtacagttaaatgactctttgtaaatttataaaattgtacaatcattgccaccatctaattttagaacctttccatcaccctagaaaacacaccttgagcccacttgtaaacagcccctgatcccacccctacccccagaaagctgcaatctactttttgtctctatagatttgcattttctggatatttccatatgtagactcatacaatatatggtattatgtgtttgtttctttttcacgtagcataatgttttaaggttcatccatgttgttatgtgtatccatactccacttctttttattggcaaattgttttctataacatggatatatcccattttgtttacccatttactatttaatggatatttgagttgttttcactttttggcatactgggttttaacccacatgcctaccccaaatgactgatcgtggctgctatgtatatgaaggattttgtggctatatctagactcaatgggaagagtgcccttgatgattagttatttctgtcagtggagagggaacagaaaatgtgggcatgcatacaaagtatcattacactgtttccaaaggggtctcttcttgttttaaataaagtagtcacatttctctcatgaaaagagttaaaagaaggcaagtcactgcaattgggaagaatcatgctcatttttggtgatgagcataccttttacatacaatttactactgcacaatcagtggctggggcttctttagcatatttttctggaaaggcaatggagccacatggtcatggctccttcaggccagtttctcactgggctcaggattaacaccatttatgtggccaagggttggtgaactcaaccgcagatagccccaagtgactgatgagttagcattcctggtgatcttgtcaacagccaagttgggtcttttttaatttttttattctgtttttttttttttaagtaaaactaggaagatatattatttccagttttcccttggggatggaagtatagacttaactatttcaaaactcagtgggcttggtggtgtctttgtattgtcatttataagaaaagagatgggaatttgagtgggcctgttggaagaatgaggaaattgtggtttatgtaaatacatcccaagcaaaaaatccagtattactttaggataatataaagaaaacactgttgtcagggggaaaaatagatagaaaaagaaaaagtattagaggataaagaagaagaggaagaaggcagaaattgataaaggataaaataaattgcaaataacgcattggttgtttgttagtcaaactcagcctacaaccatgttgtaattgttccacatctttttgcaaaagaaaatgaattggttccaacacttaaaaaaatcaggacacattatgtacatttctaagtgccctatgtgctttgaaaaaagaaagaaagtagatgacaggttgatgcgtgcagcaaaccaccatagcacgtgtacatctatgtaacaaacctgcacattctgcacatgtaccccagaacttaaagtataataagaagaagaaaaaagaaagaaagtctggtaaacatttgctataatagagtaatagctgttccctgtgaatggggcaaaaacgtaggtttattgcggcaccgttaacaatagcaaagacttggaaccaacccaaatgcccagcaatgatagactggataaagaaaatgtggcacatatacaccatggaatactatgcagccataagaaggatgagttcatgtcccttacagggacacggatgactctgaaagccatcattctcagcaaactaacacaagaacagaaaaccaaacacaacctgttctcactctaaagtgggagttgaccaagaagaacacatggatgcagggaggggaacatcacacactggggcctgtcaaggggtagggggctaggggagggatagcattaggagaaatacctaaagtagatgtcgggttggtgggtgcagcaaaccaccatggcacgtgtatacctttgtaacaaacctgcacgttttgcacatgtaccccagagcttaaagtataatttaaaaaaaagaagaaaagaaagaaagtctggtaaacatttgctataacagaataacagcggctccctgtggatggggcaagaatgctccagttggccggagtcttcactataccctactgtttacattcagtagcttcacacgtttatgtgactctgcatctgcaacatctgaaacaactgtgtccatattgactcccagccatcctgccgggaccttgggttatcaccacatttttcagagggtaaagtaaatgttgtaggggttaactgacgtgcccaaggtcaccatcagtaagagtcaaagctacttctcatttccagatatctgctgctttttgcagtctgtcatcttgctttgataggtagagaaaagaattgattaaatataaagcaaagaatggagtaaaaaacaaaggaaaaaaactgaggaagagggagtgatgggagcttttaaaataaccgtttattacttggttgaaaattaagctaaagcatggactctgccaatgaagggccaaacacaagttggttggacacatatattctttccccaggtcctagaaacaagtccacgcatcctaggcagaaaacattgttttcctgactcacagagacaactctgaaaagcatctgagagttggtttaggaataaaatcacctgtttaaattaactaacattttctaaatatttatttaggaaataatattaatatacctatcactcacaacttgataatattacctatcactcccaaacttcagtggattagcaagctccccaggcagttccagaaatgcagtttaggccagagttactatctggtggtatagcccctctctaaatcagtctctggaacaggcctgaccactgtattctgtcagaatttattgaggcagcataagaccttgtttctcacttctttggcccttggcaaaagaacctgagatctcccctgagagtcaccacgtgtacagaaatagaggagagcagagaaaacaagcatttctttttgcaacttcacaatctatttctggggttgaacagaagccattaaaacattcccatgactctgtgccaagcccccaaattactaatgacagacatgctggctcaaagggagtcactgctggcaaatatccctctggtatcttgttaacagtaataaccctgagcctttcattgaaagatctcaaagcacagtgcaagccttaattgactctcccctcaactctgtccctgaaaaaggtaattatcattatattcctcagacagtttacacaggggttaaatgggcgacggaggttgaatgatttatccttgtttcatattccgagttgaaaggaaaagtctaaataatgtcataacttggggtgaactcagctgtatgacttgctggaaccagtgggatagcagaaacagagagaacgagagcctggtgaggctgatgcaacgagagaggccacaggccaagcactgtgtgcagaggtgctgacctggagttattttagcctaaggacattatccataactgcccagtgcaggccagaaggaacagagaatctaagccagagtcctggaagtgggagaccctcaatatcacgtacctagagtctaaagccagagtccatgctcagtgatttagacaaaaatcagtctctatttctctggtgtgcagtgtaccaagagttggaagtgtacctggaccccaaacagataagaggttcatctcagtggagaacttgcatgctgggcatggcatctgggacagtcccccagtcctaggaactgcaccatcatgaagatgagcaccactgatctcacaaaccaattcctcctactacaaattctcaccttagtaaacagggcctctccttacttaagagccataaccaaagtgcagggagtcatcaactccatttatatttgatacccaagttcagatgacacaattatcttccaaaccaggcttcttatcaccacccctaccaccattgactcatttgaaacctcattatatctcccctggattattttaacagcctcctggctgttcctgttgctttcagacttttcccaagccaaacaatcgggactgtccaaaggatatgagactgtccaaaggatattcctggaatgcaaatgtaagcatggcatttataaactcccctgataaaattcttcaagttcccttccacagggaaaagtgtaaaattcaaaaatcagggtgaaattatgtttccgataaataatgctgaaataattcatcaccagcagatttgcactataagacatattaaaggctgttcttccagcagaaggaaaattatgccagctgagaacttagctctacatcataggcatgagaaacattagaaatggtatatataagtgagtatatataaaacactatttttctcatttttatttcttcaaaagacaaatgtttgaagcaagaataatgctatttataacataggcatgaatcaaattgaatggtaacaaaagatggaaggggataaatgaaagcatataatgtatataatataagagtcttacattattcatgaagtgagatgatatcatttaaaggtaggctgaagttagttaaaggtgtgtgttatattccctagggcaatactaaaaactaaagcaagggctagctaataagccagtagtggaaataatagaacactaaaacaataattgacaaaaacggatgcagaaaagaagacaattaaaaaaatgaatagcaagattgtagatttaaacttactataccaataactacattaaatattactaatcttgacactccaattaaaagacagactgtcagagaggataaaaaggcaatacccaaatataggccaactgtagaaagccctctttaaagtcatagtgtggttacaagttaaaggatacaaaattaaataccatgcaaacaaacactagacacagactagaatgtctatattaatatcatacaatgtagacatcaggataagcaatattatgaaataatatgaagaattttataatgaaaaattagaaagtacatccagaagatataacattttcaatctgtatacaaacctaataacagagcttcaacaatgcctgaaaccaaagttgatagaactgaaaagacagtgagacaaattcataattatagttaaaagacttcaacattgctcactcagtaattattagaacaagtcagcaggtaattattagaacaagtagtaaaggtatagatgactttgataacgttaaaaaccaacttgacctaagtgaaatgtttagaatagtccactcaacatgataatatgcattcttttcaggtgcacagggaagactatatggtgttatattatattataagctataaaagaagtatcaataaatccaaaaaatctgaaattattcagagtatcttctctgaaaaaattaaattaaattataaccaagaatacaaatattctatgtgaaaacatctcctaaatttgcaaactgaacaacacacatctatatagactgtgaattaaagaataaatcacaagaaaaattagaaaatattttgaactgaaatataatgatatcagaaaatattaaagcaattgtggaaaggagctaaatcagcatgtagctggaaatgtatactatattataaagtgcttatgttaggaaacaaaaatcgtataaaatgagtgacctgagctttcatttaaataatctataaaaaagagcaagctaaacctgaagggaatagaagtaagaaagtaatgagaggaagccaatgaaataaaaattagacaaacaaaacagaaaaatcaatgaaactgaagctgtctctgtagaaatacaaataaaatttataaactcttaaatagactaatagcattttttaaaaagaagaaacaattccaataatttaaggtaaatggggacatcactacaaatccacagaaattttaaagagtaataaataagggtcaataataaacaaaattatgctaacaaatttgacaacttagctcaaatgaataaattctttgaaagatacagattatcaatattgactcaagaagaaatagaaaacttggatagtcccatatcaatttttaaaataaatccttaattagaaacatccacacaaagaaaactccaagccaagaggacttcattggtgaattccaatacatatttataaaataaataacaattctacgcaaactctttcaaaaagagagtatggaggaagatttctctaatcatttcatgaggactcttttacccttacccaaaaccagacaaaatattacaagaaaagcatactttagactgatattttttatgaaaaaaacacagaaaaatccttaatctttagtaaattataatcatctagatataaaaaggtagtatattataaaaaatagatttcagactttcatgactggcttaacatttgaaaatttactgtatgatcagaataaagaataaaaaatctagtcacgtttcagtataaacacatattcatatgtgtgacaaaatttaactcttttttatgattaaaaaatcttataaaactagaaatagaagaaaattgccacaatattatacagattacctatgaaatagctgcagataatatcataattaataatgaaagactgaattcttattctctaagttctggaataaggaaagatgtcagttctcaccacttctatttaatactgttactgaagtcaaataaaagtcatacagtctacaaaaaattaaagctgcccttatttgcagacaacatgatcatgtaaatacaatgtcctaaaaaaacaaaaaaaaaagttattagaactaacaagttaattttaaaagattgcagaatacaagttcaacattcagaaatcaatttaaatctatacatcacaaagaaacaattgaaaaataaaattaaaaatacaataccctttatgctatcatctcaaaatataaaactcttaggacaaatttaacaaaatatgtacaagacctctaaacataaaactgcaatgcaatgctgagagaaattaaaggtctaaataaattgagagatataccatgtccatggattggtagactcaatactgttaatggcaattctcccataattggtctacattcaacaccatcccaatcaaaattctggcaggctatttgtgtagaaattgacaaaatacaccctttaatataatgaattttattttttgtgagttatgcaacaataaagttgatttttgtaaaaataatatatatttatacagtatattatgttataacatatattattatattatatgtaataatatatattattatataatatgtaataatatatattattacatattatataatatgttataatatatattattgtgtattatattatatataatgtatattattatatattatattatattatatataatgtatattattatatattatataatatatattattgtatattatattatatataatgtatattattatatattaataatatgtattattatatattatattatatctaatatatattattatatattatattgtatctaatatatattattatataatatataatatatattattatatattatataatatataaatatatattatatacaatgtataatatattatattataatatatattatattatatattatatatatttatctattatatatatataacagtaacaactacaaaagtaaatccattaagaagttagaataacctcttctggaagagaagaaaggtcagaaaaacattatgaattcaaaaatttacctaaaataaactaaacttgaaaacagaaataatgagtcacctgggttagcaaaactgcattccctgctactaggtagaagagagagctaatgagctaagctaatttcagtactaaaaaaattactggaaaagttacatttttgcatgcatgagtattttgcctatgaaacatgatctctcatcccttgttaatgaggaggatatctattcctcccacttcaggcatgaatatcactatgctattggaagacttggtccccaagattgcttgaatgactatgtaaggaattggagactagagccaagattaaattccgatattaaacccagtgcttcaaaggacctaaaagagcatttgtgcctctgaactgtacaaaatttctgagaaagaatctggtagccttcagtaaaacaggcaggagctttctgttttagaagccctctctattttcagcatgctttctgatggtttctccatacttgcagtgctgagaaatgagcatatacatcaaactttgctgtgcctacatcaaacatagggactttcagcttctttgatcttgatactatttataatttgttttgtctgaattttaggagcactttaaacagttacattgctgtgtatggaattagatatctctttctgctgcaaggtaggtaaaatgcaccatattatcatgaatgcagggctgtatacttctactcatgaactctcaaggtgtttgttttaatctcttcttcttgactgacaagatcatgtgtttaatatgaattgttacacaatatcttagtgacatctgattgtttttttccacacttggagagaggcagcctctaactttgaaggaatatcagcaggtaaacacgagaacattacttgaaagcatgagacaaagcttcaaagcttcaatgcttcagggtgcctagggaacagtaagcaaccacacaataagtattactgaattccaagataagaaggcttgtggaacacctgaaaaaataggtaaggattcctgaaggaaagtgcaccacagattatttcagcagctgcatcatccagaacttgagcaatattttcttatgttcagtcttcaggatgagcaaaacacagcttccaaactcactctaagcaagtctcagacggaagatgataggaaggaggtgatctttggtaacataatcaagttgctcaacttggtgctggtgaagcctctttcaagatggttcacttatacggctggaagttgatcatgactgttggctcagagctcagccaaggcttatagatcagtgggcattgactcctctccacgtgagcctctccacagttgtttaggcttcatcacagtatgttggctgggttctaaaagacagcaaccctcaaaaaacaaaattaaaatgcatggcagtcttttgatctaacctccaaaatcatatagtatcatttctactggactctcttggttgaagcagtcgggaagacccacccaaattcaagaacagacacagacaccacctcttgatgggggcagagtttaatattccagaagaggctgtgatatggaaaatacagttgcactcatctttggaagataatctgccagatcaaataactttgagaactattctccatttctccacttctctatgcactctattgtatgatttcttttttacacatggaaagtaatactgtacaccattatgcacacatgaataatgtaatggaaaaagtaaaagaatatcctctctgaccttgattacaaaagcattttatttttaatttttgttacttgttttttgcttaatactctcattgtatagtcaaaggttttataaacatcaattctcatcatggatgggataaaataagtgacaacatcactttactttacttaccaatggcagatagttctatctgaacccaaatctttcctctaaattattctcaacatatttttccataaaatcaccactaatcattgatggttagcatatgtgaaaaaatgattttgccatcctagtacagtttgataatgtagctgcctggaccaagatgttaaaagcaggggaaaatctgaacctagatgggggaaggaggtagtaagaacttaaaataatatgtggaaacaaaatgaatcactacattacccccaaatagttggtgagagaagagccaggctataatatgacaggttcaattcagatttaagatgagattggggatatctgtggagacacaatgtgggaaaatctaggtgaggtatagttagggaacttaagggttgcgttataaggacaccaaattcagagtaagactgtgaccagaattctgctcaaacaggtgtagtactaacctcaaggatggattgatgagaaccaagcagtggtcagcactagccttctaaatgaagatcacaggcaggactctccttcaggggttcccatgtagggaaagagaaaccctgagcaggcgccttctcccggcagaacaggttctgtcctagctatcatgccaggtgtatataataatatccaaattcttctaatacctaggtaatgctgatattaggctctccctcttctgcgctagtgttttccgattgggtgtgcatgtcagactaatctagaaagcattaaaaacaaacacacacacagaagactgatttcatttagcttttggttgatctcacaagccgtcaacaaaatttgagtcaattgaagttagcattaaaatagaagaaatgttctaaataaccaaggataaatgaaacaaggaatatgcaggatgttcatgaagaaaagtcacatattgttgaccaaaataaatgaaattgcaaaagaacatgttcactctgacacattttgtacaaaagttttaaatatgcaaaacactatatatatagttatggacaaataagtatgctgtgaaattagaggttaaaaatgcacaaaacaacacaaaaaagacagtgcagcattattattattgttatactttaagttttgggatacatgtgcagaacgtgcaggtttgttacataggtatacatgtgccatggtggtttgctgacagtgcagcattttataatggtggttacttttgagagtagagggaaattctggtggaggaatgtgcctgtttctataaacttttagatgtcaatttaaaaatatttgaatatttgacacaaaaaacaacatgtcaacatttgatcactatgtctagttttaattttctctatgaaatagttattatttaagtgtaatcaataaacagaaaatgataatgatggagaaacgaagaagatgaagttgagaaggaaaggaagggaaggaaggagaagagaatgaaaaagagagagaagaatagaataagaaggaggagaaggagggaggggaggaggaagagaaaaaaaaggaagaaaggaatgaagtccccaaatattcgtaagaaaaaaaatgtttaattccacttggatctgtgttgaaaacttgacagcctgtttacgtttcatttagacaaaataaatgctgagaatgaccccagaatataaaataaataattaaaaaggtgaaatctaccctatcagatgtcaaatcatactatacagctatggtaattcaaacacagaacaaaaataagactacaaattatttaaagtgtggggaaggattattaaataaatatgacatggatgattggttaaatatacaggaattataacaaggcaaatgtctcctcccttacctcataaaatttacctaatttgatttaaattgatcaaaaattcaaatattaaagaagaagtagtaaaagaattgacaaaaaacaataatgcatctgattcatctcagggtagaggtgccctcattataaaagcaaagggagaatccataaaaaaaaaaatgttagggctgggcgctgtggctcaagcctgtaatcccagcattttgggaggcagaagtgggcgcatcacttgacatcaggagttgaagaccaccccggccaacatggtgaaactctgtctctagttaaaacacaaaaaaattagcgggtcatggtggcaggtgcctgtaatcccagctactcgtgaggttgaggcaggagaatcgcttgaacctggggggtgcgtaggttgcagtcactgccactgtactccagcctgagaaacggagtgagactctgtctcaaaaaaaaaagaaaagaaaaaaaagaaagaaaaagaaaatgtttgggaggttttaaaaattgtaatacctggttctgatgtgggtattgtgagatggatactttcttacaaacattttggcaacatggattaaaaccttaaatgataatattcccttcaagtcagtggttctatttctaagaatctaacctagtaaataataacaaatgcacacaaagatttaagtatatgtatattcattatatgattatttgcagtattccaaagtggttaacaattcatacacccaatgatagaaaatggagaagtactctccatacaatgctaactggcaaaaaggaaacataagaataacatggatctaatcacataaatagaatgtatgtagattgtgagtctctggaaattattcctgtttgtcattcttctttacagatgtatgtattctacaattaacatgaattattttatttttcattttaataaattatgttattaaattatgatatattgattttaagagtcaagaaatacataaagaaatgtaaatttactaaatgctttctttcatcccaccctcctatccccatgttccagaagtttatccgagtttattgtgtttactttcaaagacaactgtctttggatatgaacacatatctatgtttggaaacatcacatagatatgtgttcatgtgtacagtgtgtgtatacatatatgccatactaagacactaacgtaagcttcctgtgtgccagggcagtttttggtttggggaacatggtgattcacttatgatgatcccagccaatggttaatgtggacacaaacacagataattctgggaggcactaaaataaagttagaaagttagactcaggaacttaaagttggatttgatccttttttttctcatcagtgtatattttcttttctttttttgttttattttatttttttttaggttcagggtgtacatgtgcaggtttgttagatgggcatattatgtgatactgaggtttgggcttctaatgagaacgtgatcttttctaatgatgagatatgaggttggaggttgaaggtatagaaaggctttctggaggagccggcccttgatatggacactgaaaagagagatagactctccaggatacattaatctcaggtggagatagagaaaggctatttctgacagaaggaggagactaagttggggaagttgagcacaagatcaggcctgctgggcctggaaattatggaagatgttagtaaaagctaagacagtggaggttgtttcagggcacatcacaggggatctagacgtgcgatgtggattctgaatacctgtctttccacagtaggaggtctttgtggttttgagcaggacgatgctgctgctgacagagacaaggacagattgaagagggcaaccagaaggcagggagttaagtcagccagcttaattattaacgagatgaggaaggccagaactagagcatttttagtgtaaagggaggaaagggagagaaattcggagagatcatggagggcaacacagcagggttagaaagctaagctgtgcctgggatatctgactcccaggggtcatggtcaggaaggatggtaagaaagagggcttaccccttcttacatttcagacatatgttcaatgtaattcaaactttttaaaagacttcttgttgctttttaacttcccatgtcacgttctccatagtcacccaagtcaaagcctgaagaaaccaaagagacatttctaggagaagttgaaaaatggtgactggagtcacctccagtggcctccagctttggtgcattgactccttactagaaagatgtagggcttgctggaaaagcaataggtgtatcaacaggtcaaatgcccttgaccctgccaaagaaagaaggactgacaatgaaacccacatagatggggacatttcaagggcccatatttcctaagagtctttagcctgcatagggttccacttgccccttctgatctctgtatttttgcctggacttttctatggtggtggtcacagctgaagaggcgaatattactatattttgatcttggtaacacagtaattaattattttttttaatgacctgttaccatagagattaataagcaaaagctctaatactactagcctgccagggagttcacacatgtgaaatacttagaatagagtgacacagagaaagcacaccatatatattggctatggtttgtattcagattaatgaaaacatcacacttcagttctaaaggtgtctgtttcagcttctctaaccctccagcctagactcagtcctgtatttgccctgaaaacataggtaagcctggaatgactcttggtgtcataaacttgggatcccctgcacccattgtgggtctgtctgtggccactccagccatgattgtgaggtctggatgactcaggcctgctttgcactcagccaggcaccttttttagaactgaagccctattctgacctccagtccacttggcttgggccctgacacctgtctggccttaagaacctctctgcacacattgatgccattctctgaaccaggcagcctgacccgagcctgacctggcttgactgccactcctaggagaatttctgctgtcctcttctgcctcagatcagacccccttatattttatttccggactgactcaagtcatagtcaccatgctcctttctcgttattcaatacaagccctgtcccaccctgactgcctccctttcccagtgagcagatgcttttgaattcccagcctgatcgcattcaaagcgtgagatgggggatcttagaaatccaaactccccattctatggatgagaaaccgtggctcagagatgggaagtgcattcctccatcttacaccctgattgtaggacagacagaaggtaaaatcccagcccctgggaacatttgccttggaatattatcacaattccaaaaaggctatggcttgcttcctccacttgtccccaggtaacctccaagagagtttctttctgagacagtacttagcaagtaattccttcttacaaaagtagtcaaggtcctcagatttacaaaccccttctctccttctggcattccggggttgtcaggatattttggtctgtcagtaacctctggggctgaaacagaggaagagaaatcattggaatctttgaagcagaaacagcaacatcaaatgtttcctctatgtcctgtgagttggcaaaactgcaggtgtagaaccaaggtatccacatgattatttcaaatccccacatcttcttgactttttaacagagcctattaattgatacactgagataattgacacattagtaggagtctccctggccacttccagtgaactaagcaaacacatggaaagtctgacctagcaggtctgtggtccactgggacttgggagtccttcctattcccagcgtgctgctgagactattgggattacattcccagtctttggcatttccatacatgaacagattctgaatgaagccaaaatcaagtactagaggattaagtcccggaattgcaataattttgaattccatcccctccatctattgacacacggtttccaataagtcatacaacccagactgcagtgtccagctcttaaaattttaaaaacaaacaaaaacagaaaagcctctgtcttgctttatccatggaatttaaccatctagatagaagaccaagtacacaaaggtgctttgagcattgtaaaaatgtaacaaaaacattccacttcctttttaatatgccatgcaattctttcaaggatatcggaaaatagaggatgtaaaatgaggaggggtagttgacatacacagtctcaaatgttgcttcctcatctgtaaaatgggagcaagagcagtgccacttcataaggatgttttaagatctagaacataatgacaggcatatgatgacgattttaaatttgagtcgtgtttgcaaatgaaatccagaacattccctgctgctccagctgatcttgggaggcattccagtctctttactgctctcctgaaacagcgaggcaaggtccttccctggattctgcagtgttttaaagagaaatttcaaactttcccgggaggcttttctaaagggattatgtcaactgaagggaatgaacaggcaagaaacaagcagccatgccacttgacaagatgagggtggcttcctaccttcagctcattacacgtagcctgggagccccttcccagttcccatcacaccttcccatcagggaggccatctcgaaaccgtgaaatgctgctctcctccaaaggcatcaagtctcctcaaagtctgaaaccaaagtggaaggactaggaggctccttgccaagcctcctaagatcacattttctggctgagtatggcctcctcccagacatttaacattgggcgtgcctccctctttcagggaaggttgggcccacccacagggacatagatttaccaaagaggcataaatgaacaatgatcaacactctgcagcacagaacagagacacacacaatggaagagttggaaaaaaattgtttccctagagaagcactctatctatgcaaatagctaggaccactatccttctacctaggtattttttattttctctgcaagagacaaaagtggcagaaaatgcctccaaagaaagaaatcctaagcctcaagaaaaaagataaaagggaaggaagggtgttggaatacaaaagctggaaaaagaggttggcttttcaatttgggagtaaactatattcatggtccttaagagaggatggcctgtcagtgagaaacaggagactctgggaagacagaggcatgggagaaagatcgttccaaaatgtgtgagaatttcctctaacttcgttttcttctctccctagccagcctgcctcccggtatatgcatatatgtatgtatatgtctgtctgtctatgctaaggcaagatgaagggagaaaagccctcctgccatgggactttaccagcgtcctcgcatagcattcataataataaccccatcactcatcaaaagtgctctgcaggccaggcctcgccgggcctgggcaatgctctgatcccgcagccagctcaggctataattgcaaacaccctgcccccgggaagtgtcaggttatgtgaagacacttgggctttgctggtgtctgtaaaatgcaagttcaaggggactttttaacatcagaagcaaaaatatgagagtcaagagacaggtcccttgtgccctgcagaagatcacagtagagataagaagtgggaggcaattgctctgaaggtgggaaaaataatttgaaggcagcagaacagacacaaggtaattaccgctcagacacagcacaggcaaaaaggcccttgcttttagggaaacaagaagtgaacagaccaagccaggaggagaggcctggctcttatgagttgggtgaattgtcagtgtttacttcctgataggaaggcagggagagagagaaaatgaccccccaaaggccctctcaaacttaacaaatttgtgagccaagttaggtatgagtttttctcaacttttcgattcggttttggaaggacagtgtgcatgtgtaagtgtgcgtgtgtgtgtgtgtgcatgtgtaagtgtgtgtggtaagctggaaaggtcatgaaaacatgaaggaaaatggtacaagaaagagatatcaaaaatgctacctcctatctgattctaactttatgacattctggaaaaggtaaaactatggagagagtaaaagcatcagtagttgccagaggttcagggacagggagggaaggatgaatgggtgaagctcagaggatttttagaacggtgaaactcttctgtgtgatactgtaatgcagggtacacgtcattatacattgctcaaaatcctagaatgtacaacacagagtgaaccctaacataaagtatggacttcaattaataatgatatattaacattggctcatcaggccggcgccgtggctcatgcctgtgatcccagcacttcaggaagccgaggggggtggatcattgaagtcagaagtttgagaccagcctggccaacatggtgaaaccccatctctactaaaaatacaaaagttaaccaggcatggtggtgcacacctataatcccagctactcaaaaggctgaggtaggagaattgctttaacccaggaggcagaagttccagtgagccaagattggaccactgcactccagcctgggtgacagagcaaaactgtgtctccaaaaaaacaaacaaacaaacaaacaagcaaatatatatatatatataggctcattaattggaacaaaagtacccttgtaatgaagatgttgataatggagtactgtgtgtcacaggaaaatgggggactatgagagtggtctttattttccactcaaattttctgtaaacttaaacctgctctattaaaaatagtctattaatttaaataaaagagagagagaaaagatgtgtgtgtgaatgtgggatcaaacatttaaataatcccttaccatcccaataaaaagttgacagtttggtaatcagaggaaaattgggtattgtggcccaggaaagagcctcagagtaaaaatctagaagtacctggaattcaacttgggtgtagtttaatttcatcaaaatccaggaaaatagttgaagtcatcctaccccagcaaagagaaaatgaagcgtcttccccgtgcggctctgcagcagggcttcctggactctctgatggagggcggctttcatgttattgtcatttttttgttttcattccagtctattaccctactgatacgtttataaaataaaattgaaatgagtcacaagaaaagaatgacagtgcacttgggtattaaattcttgttgaggtcttcttacaaaggcttattctcataagtagcactgcactggaggagagtcactctactgaagaccctggcactgtccaaacccaacagttagcaaacacaaagaaatacaacaagggaatgcggtaagtatttcccaggaatgtttcttgtaaaacaagggcaccatctcttgtctgaacaattgttctgttccctagccttgctgtcttccaatgtactctcctacagccatcagagacatcattctaaaatacagatgtaactgtgccactttttggcctgacaccagatagttttttgggtatctcgggatgacctgcgcgttgtttagcaccttattcatagcaaactggcccctacttgcttcagtaccgggtgaaccaaggaaagtcccaactgggttctcaggctaagcaggaagactggggtttgacccaagtaatccccaagaattagcaccctagtccactaacatatactaccaggtgtgggcgggtaagccgaatttaaaaccactgagtcaagagtagtcacttagcaaattctcatagtcgggtggggatggtgagaagcatcttagaatgcccaccaaaagaatttcatttgggacaaaaggcattccatgtaaaggggccagaatgaacaatggcatggaagcaagggatagtgtggaatattcaggaaccctcaagacatcctatgcattttaggtagggaagagcctcacagcttcttttagtaaagagagtggcaatcattactaattactgcagaaatcctcaaagttgacattctctaagtacctgtcatgaagacatcctctacttgcctcaaattggcatatttggaatatgctttaattataagaacttgccagagactggggaaaatctatagaggaaagagaagtcaaatgttctgagttttaatgttcacatcaatccaatggtgtgggctttctccaattttacagatgaggagactgaagtctgagagaggacagtgatctcagacagtcacactgagtaagcagcataactgagtttccaactgaggtctacgtgccactaaaagctgtgcattttgtacaagttcaccactgtttatgcacgtaggtgtgtatggaaggtggttattgagaggagagaggagagtaagaggcaaagagttacacattttaatcctgtgttggcaaattatatatatatatatatatatatatatatatatatatatatatatataaattgaactagttaataaaaatttatttgtacagagtgttttttgtgtcaaacactaagtgctttgtatgtatcatccacttaattcctacggtaactcagtaagcttgatgtggcagattgtattatattattgtccccaattattcactgtcttctctgtaaaactatcatgtactcctgcccattgtttgtatgacttatggtgttgccctgtaggcagaatatactttcctaccctaatgatcagatgggccatgtgacttgcttgggccaatggcatgagaacagatgtgctgcttgccatgtcttaaagtttctcagctcatagcctgggtcttggaataagaaatcgcatggagcaggggcatagcagttgacctgcagctgagtgacaaatgaaagtcataagtcaatgagatactgggggtgtttgttactgcagccaggctgatggatacaaatgaggtattttacaaatgaggaactgaagttgggggagacatctttgcccaactcctaccacttgtaagtagtgtctggatttagatccatttctatttgacttaaaagtccatgccattttaattagaattcaaaaacctcctgcaaagtccaaattgtttaaagtagatcacatgaggtcacttcccagacaggaaataaagacactgcctctggagtctcggcatgttccatgtttcctgtggcttctccatccttccaagccctgagagattccagctcgaagcatccattttgttaccttaatgatttcttaaaagagaataaaatctctgaccctaccacctattcgaagcattctgtaacaacctaataatggggctccctccccccagttgtccccttagagacttatccacactacagttaggacaagtttttaaaaatgatcttgacactccctggcttaaaaccttttggtggcttctcactgctttcagaatcaaatcctaaatggcctgtctcttgccagcctcccctaatatatcttatagtgtgctgttccttgcttattatgtgccagacataataacacccttttagccaccaaatgggcctagctgtttttccccagctcatagcctttccacgtgggattccttctatcttgaccacccttccatctcctccctacagcctcaactcaaatgtcagaaatgatacttcatatagtgtttcccaaatccttttccataaccttcatctgggtcacccaaaaaaatgtattttcttgcctgcttaacattagatttgatcatgtgactaattctgggctaccgaaatgtaagtggaagtgaggtatatgcagccatccaggctgcaccatcctccagacccctcttcccctgcctcaggtcctcggcataccacttactttcatctctgctatgccactatctttgctttacttacgatatttgtcaccatctggaattatcttcttaattcattggtaccagatcattttccctctaccatgcagacttaaagctctaagaaggaagggcctttgtccatctgttcagttgcatcacagtgcccatcacagtggctacatataatagatgctcaattaatatttctgaaatacataaatatatgaggaaataaatgaatagagctcttgcaaaaatgagttaatttatgtaattagtacagtgcctgatagaaagtaagcactcagcaaatgtatctaattatgaagatgaagaattgaaacaaaaggtctttcctttcatttctgtgctatggaaaggaaggaacaaagatgaggttaggtcttgggaccaaaggtctacaaggggcagtctcagtcttgaatatagaggtggcctgggagaacagttactagggagtagacagtgagagtggactcagcttcacaagtcagaacttcttttcataacagcaacatgatgctggaattattagtaagggtctggtatgccagggccaggacatcataaaccttctgcatccacatcacagagcctcttataagaattgctccatacgtttggtagacatttactgggcttagactgtgggcaaaattttggctggattctgcaattaaaagataaataaattaccacccttgcccataacaaaccagagtgagaaacagacatggaaacaaataattaaatccaaaatatgactagtagtgtgatagcaggatggacaagaggatactggagtacagaaaaaaaaagagtgcctctgtcggtgcagtcaggaagacttcaagaggcaacttcacagatggaccttaaaaacaagtatgtttcccaagaagacacagtgggaagggcattctaggaagagggaacagtatatgtaaggcatggagtcattataaagtcttcacaaatcttggaaaaggtaggaagttctggtggtttaagcataaggtaagtacctctcacaagtatgggaatgtgtggttttgctttctccatttgaaagaaatgtgggaaatagacaataaaattatgcacaggaaaaaatgaatctactggtgaaaaataaaagatttactgattgtttttgaatatactgttttgttgtagtgtgttcattcaagctaataatagagataatttctggcatctaaactctttcaggttctttcttaaatgtattgctcaagcaatgttctactagtaaaaccgaaaactcaaagttagaaaagaatgacccagaataccaagaacctaataaccccgtgttcatattcccaaggcttcagtttgactgacccatccctttcccaggagactgaatgaatgaaaacaggacttgactgcattttaactatggtagaacactgcaggggcccctgaaggatatgtatggaatacctgtcctggagaacatcacctagaaatagattatgtataaacctgcctgaaagagagctggccattgtccactcttgaagttgtagatttccaggataaggagaatcagtatacatctctagttcatggattttttatcttggatccagacatataggaccctccttgtctgctgtggatggagtagggggtgtccatggaaagtgttttggaatccaggaatcacttgaaattgtatgccaaaatttttttttaagtagacatgtgcattttccagggaaagggtcctttgtttactggagagtttgtgtatgatttaagtttgaaagtttttctagttgttttctgttcattcgccagatcacatggaatcaacatgttttcaacttattgttctgaagcctgggaactgaacaagcctgactctcagttcttggcaaaggatagagcattttcctaggcagtctttcagaaaatcctgctatttctccttccaaaacacatctcaaatttgtcatgtgtctccatctccatcaccaagcccctggccaccaagcctccccatcatctctcaccagaacaaatgccaaagacttcaaataggtctcttttgttcaccctttccttgctgcaatctaattttcacatagcatcttgagtgacactttttaaaatgaacattatgtcaccaccacactgaaaattctccagtggtttttcatgttgccttcaatataatccaagtttctcagtatccaagggccctaaagccctagatgaccaatttcctttgcacttttacaacctcaggtgatgccaccttcctgtttgctcactagaatccagttaggctggacttacttctgctcctgatcttgcccagctatttcttaatcccaggcccacatccatggagttctaccttctggaatgttctcctttcttcatatgattagctccttgccatcacttaggtaagtctcaacttaaggatatctcctccatgaatctaatttttttttttttttgacagattctcactctttctcccacccaggcagtggcacaatcttggctcactgcaacctctgcctcctgggttcaagcaattatctctctcagactccagagtagctgggattacaggcacaggccaccaggcccagctaatttttgtatttttagtagagatggggttacaccatcttggccagactggtcttgaactcctgaccttgtgatccacccgtctcggcctcccaaagtgctgggattacaggagtgagccaccatgcccggccagatagatctttactgaccatcctatcttggtagtttctcattcttatcacatttaatttttctaattataaaatcctattcatttatcacaacagttttttagaatgcattttatgattgtttattttttatctgtattctctactagataataacttttcttcttcacagtcacatgtccagaccatgatacaacacctgccacacagtaggttgaatggttggataaacagggtaatagatcaatgaatgaatgaatgaatgaatgaatgaatgaatgaatgaacaaatgcataaatggatgaatgaaaaaataaaaaagaaggcctgtaggcagtcttcaggctccatctttctgtgtagaactaatgccaccacccaggtgtgctaggctgtcagatatgcgaggatagcaatggtggccaacagggatatgagttagaaagagttgagaagggcatgctaaggacaattaatggttgcttgttagagggtgtggcctgcagtccaaaacaccctattctcaagggcttgatgtgcctaagtttaatttgaggcaacggctgtatcttggactatagtaagggaggcaggggaggggaggaggattttcagactgaatatagtgcactaacgggctaaaaggaaaatttggaaggtcttcagggacgtttccttgatcaaggaaacctgagagtagttttagatgagcaagagaagggttgggatggaggtgagaggtgacgattatctgatattcaaccaaagctcaaaacaaatggctcagggatgggtgggagagatggtcaccttgtcctcttcctctagccaggctgacaaaccatcacacctccagtaaaactcacaagcattgctgctgttcatttcttaccttctttttccccattcctatcaatgtctgactcaaatctccaatcttatctgtctcccattcctgcccctacttgtaaagctgaaggttgcttatactggatcccaggctcccttatctatccctagcctagtaggctcttacctggttctccctcttgagatactatttaggagggttccttaacccaaactctgtcccctggaatcaaataatctttgtcctgtgatttgtactctagtcaggtctgctcaggtctgagagggggaatttgagggccagttcctgttaactattataactttgtatttagggagggagtatagcttactagttaaaatcatggtctcttaacccatgggtcatcctattaattcaaacctcagcaattccgcttaggtgcaacttcaaccaaagtgacttctcctttccaaatctcagtttccttatctattaagtgggtaccaaatagtctgttcctcctagggttgctataaagattaagtaagatgatgcaattgatcttccactcagccccttgaatttttaaaaagctcaagctgatttccagctcacataacctgcatcaatatgcctgaatgtatgtttgtttgtctgttttaaaattttgagccataattgcagaaaatcccattgcctctccctctctctgtctgtgtgtgtgtgtgtacatgtgtgcacatgcaaacacacagaaaaccaaaagtgcaaaggagttacatcactaggagcagggtccaaccagtgaccatggtacaactccctcacatttcaggtgggataattccaaagcatgtgtattgcacagtattccacaactccctcagagaaattagttttcattattactatgatagctgccttgataccacactcattattgctcctttcatttccttgtataatttccccacttccacatctgcgttagacatcccaaataaactatttgagccatattcttggccttaggatctatttcatggagaacacaccccaagacaaaattctcagcatagttccaggttctttgtaaaccttcggtattcaatgactgagctattattgttatgggagaaacctgacctcatgccagtaggaaagacctcactctacgccacccaaacactaacaaaaggaacatgctgcccatcacagggaataatcagcctaggtctgccagcaaattgcagtcctgcctgcacgggtcactagccaagctgcctccttgtgctgtgagcccagaaactactgagggacaccactaaagtgttcctttttggcacaacaccccagcctccagcaaagcagactgcaagactggggaataagcctgtctcttcaggtggggtgagaagcctccctgacctgcccagaacaggtctggccagtgattgctccattgttccagatgccaatcaaaggcgaagccagggcactttgtccaaaaattggattaagaacctcagttgggcacaagcaacacccataaatctgtctgtagatcttttgcctgttacccattttgcatcctcagaagttaccctctataaaatttatctcccataaagagagtttcaggggattatccccaccaaagacctttcaattttgcaggcagattgccaaatccacaaactgattccagcccagatgtcctgggagtacactcttcactcccttggccatccctgaggctgcttccatgttgagtacttgcagacacaggcactacagaaccacataagttctaggcaaactccagcctcaggtctcctggatttccctaatgtaagtgaaaacagagcctcaaaactctttgacccaactggctggctctggtcactctgagcattttcaactataagggcaaaaacgttttcacagagtaaaggcaaagacttaggtacaaagaaaactcctcaattcctctatgatccaaaggcatctcagctttaattccagtagtaaaaaacctcctgaaagcaaagacccctgacactttcctctcacagccagcttccagattctcaccactctctcagccactccctaaagaatgttccttgtccatgtctttgtctgcttacagactaacaacatacattaaactgggatcatatttgactcacataaattcagcatccactgcatgtccaacaaggtgttgcttgaagtatcacataatcactaagagagtgggctctggtgtcagattatgttgctgcaaatctgtgctgtctctttctaactctgaaatcttggcaagttagataaacctttctgatgcagttttaatacataattccaaatattttcctcttctcttattcagaggtggagattatattcccttccctcaagtctaagtggacttgtaactgattgaacccatagaattcagtagaagggacactatgtgacttcttccaaggctcaattataaaaggccatgcaacttctgcctggttctctgggaacactcacacttggtgtattagtccattttcatacttctataaagaaatacctgagactgggtaatttataaataaaagagttttaattgaatcacagttttgcttggctggggaggcctcaggaaccttacaatcatgatggaaagcaaaggggaagcaggtgctttcttcacaagatggcaggatagagatggagggagagcagggaaaactgccttataagaccatcagatctcatgagaccttacacagtatcacaataacagcatgggggaaaaccaccaccatgatccagtcacctcccactggatctctcccttgacacgaagagattacaatttgagatgagatttgtgtggggacacagagccaaactatgacacttggagtcctgggccagtaagaagggtgactatcctgagaccagcatgctggagtggtcatgggtacgtgcttcagcagcagcaccagctgaactagttcttcagccatgccagcccagacattaagcacaggagtaaagaagcatcttagaaatggatccactgtttccaacccagctgttcaagttatcccagccattcatggaattccagccaaggcaccagacatcataccaggggaaaactgtccttctgtgcccttcccaaattcctgattctccaaatccgtaagcttactaaaatggatgttttttgctattaagttgtgtgattgtttgttacacagccatagccaacttgaacattctctaagcctcagtttctctatctgtgaaatggtgccaggaatggtgtctgccctatagagtttttttgaggaataaataattgctgtgcatctagtacaccataatcactcagatgctggtgattattactatcatcaccttcatctcatttaactgaaaaacatatgagttaaatctttttgatgaatatctcctagttaattgttgtgcaaactgtctcttctaattagatgaataaaagttattgatgaaaaagatgagcccaacttttaactaaaaataatatgtctataaggtatcagaatgtcatcagttctttaaaaatgcaaaaacaggtttggtaagtgtttctgtggtgggagggggcgatatctatatgcatctgtgacttcatgtttgctttacattcttctccatgcatatgtttgcaaaataattgacagaggcattacaaagggcaaagggatcgtgtgtatgtacacatgcctgcactcacagcttctatagtagttgaagtacccaaagtggtaactgacactccgattagtcagcttcatcattcccttccaagcctaaatgcttttattttctcatccacagatcgatatggctggcaagtaagtgtctgtctgccacgtcaggacagtgagacccttgcaggtcagatgaccttagcccctcctgcgagtcctcaagcccagccacgctgagcaggtgtctgagaagtgggccagaccacacttgagcatccagccgtcagcgtacaaaatcagatctgatcggcctgcggaagataaatgagctggagtccccccagccccagatttggtcatctctttatgagctctgaagggcctattagcagatctgatgagtgctgggggagatgaagtcggcctcgaacaacgttagctggcagaatcaaatcattcccaatccccctagggagaaggagatgggctggctttcagaggcagcgtcctctcatctccattgcctataaggtttatatgaacactcagttgggggaagaaaaaacgctaagccctttttttttccggtagaatcgactaagaatttcctcatatatctaatagcttctcctcaggcaatttgatgtccctgcttagacaggtgctctctcattttccctctcagagtctcagcttaggagggagctgcaccactcagaagggccagctgaagccagctcccttgtcaccctctctgagccctgcatcccactcagctagaaattggaccagccttcagggtgccgagtggagcctcttctgtgaggccgggcggcttggtgggagccacagggcaggggatcagaagttcagttcttggtagctggatgacagtgggcaattaatactatgcagccatagtgaactcctctgtaaaatgagacagcagattttgtccggacttggcagtgtgaagattaaatggaatcacaggtatccagctgatgagatgctcattgaaggaccctttcctttctctcattcagcattaacaggcagtctgcctttccaggcccaagaaaggggtatctggaagaggcaaatagcaaccccaggggcttcaacagcttattagaagcatgaaaaggaagataattaaatctagggcagactttgaagagaaggaaacatcttcccaaagaaaagaaaactgcaagctgataaatattttattccttacccccgcatctgggataacatgaaatagaccaaagaagacttaggtgtgaatcctgacttagtaattgtgtgtccttggcctggtcacttaccctcttggattctcagtttctacatctgtaaaataggaacaatcaggctatttatgttgtaaggaaagtatgcaaaagtgcctaaaagagtagctgacacctaggatcaggtttgccccaagtatcagttaccttctcccttattttcttttttttttttttttgagacgaagtcttgctctgtcgcccaggctggagtgcagtggcgcgatctccgctcactgcaagctccgcctcctgggttcatgccattctcctgcctcaccctcctgagtggctgggactacaggcgcctgccaccaagcctggctaatttttttgtatttttggtagagatggggtttcactgtgttagtcaggatggtctcgatctcctgaccttgtgatctacccgcctcggcctcccgaagtgctgggattacaggcatgagccaccatgcctgaccccttcttttcttatttgtctgcacaacttgcaactgattgcctacctgccttgcctcacagttctgtgtgtctgtccctgtgaactctcacattatccttcctctgtggtaaggctactcatctctggctgccttcttgctcaatatttttttcttctctgtagggcaggcagctctcgtaatcctcctcaatttttttttcttttttttttttgagatggagtctcactctgtcacccaggctggggtgcagtggtgtaatctcggctcactgcaacctctgcctcctgagttcaagtgattctcctgcctcagcctcccaagcaactgggattacagatgcacaccaccatgccagaccaattttttttttttaagtagagacagggtttcaccatgttggccaggctagtcttgaactcctgacctcaaatgatttgcctgcctcggcctcccaaagtgctgggattacaggcacgagccacctcttgacattgtgatgattttttgtctgtctgaccaccctacttgactgcaagctccatgaagttgggggctgtctgttactgactaaataacattttaataaaagttttaaatattgctttttaaataaattgagagacccttgcacactaagtgcagtgccaaggtatacaattgaggagagagaatgggacaaaaaagaagctgccctctgaggacttaaagccttcctttgtgggagacaaaaaacaaagccaaaatataagtaaattaaaagataattaatgtctgtaacatgtccttacaaggacagaaaccaacaggctgagatgagagaaactggaggaagtcactttaggcaggaccagctttcaaaagaggctccattcatggaggccatcgcataagacacatggatgacatgaggaatgaagatgaaccatctttcccgaaagtcaggaaaagagaattccttcaggcagagggaatagcatacacaaagatcctgagtcagagaagagcttggtgggtttttgagctgaaaagaagtttctgtatcagagggaagcaaatggcagggagagccacgtctggtaaacacaaggaatgagacaaggagtaggtcacagagctcagcagaacaaaatcaggtgtttagactaggtgtcagcaaacggtggctgtttttataaatagtgcctatttttgtaaatagtgttttattagaacacagccacactcattcataggcacattgtctatggctgctttcaaggtgccatgtcagaattgaatagttgctacagatacctcattgcccacaaaacctaaactatgttctatcatgccctttacaaaaaaaaagaagtttgctggcccttggtttagattatgcaacaagaagtcagtttgaagggcttttaactgaggagagatgtgatctgattagacactcagaacagtgcctggcacacaccagtttctcaaatgtgttccttgaatgaatgagtggatgcttagatgaataacgcttcattatccacaaccatataatattatcccctctgttagcacaaataatcggagggtttacaggactgagtgggagcctcccatccatccaggcagactacgttttccacagtgctaacagctgacggatacttagaaaattgaatgttttatgcagcttcagattggaaatagcagtgtggttttcaccacagggaaccctcttaatgtaaatccaacccaattacacacacacaggcaggcgccaaatttgcagcaagactgagtttcgcccagcagcaaatgaagcacagctccagagaggaaagagaggtctgtcagcgagggtgtgggagctgcagaaggcacctcaaccctaagggccactgctgtgtgtgactcatgtgtggagggtgctgggtagcttaaagagcctgaaagaaaaaggatgaagtggcttatgcaaatgtacagcaagctgcattctgcaattgcaaaatcatgaataggggaaattgctggaaaatcaaaagtaacttttgcccccagagggtccttcctttgaccagttacagagatgaccaaagccttagagaaagagactgagcttttaaaataacaaataattgcaatgagctttgtgagatacgcgcaagattagatatatgaaataatgaggtggagagatcaaacacaagaactggttaaattaaatatctgctttgggccgggcatggtgactcatgcctgtaatcctagcattttgggaggctgaggtgggaggatcataaggccagaagatcgagaccatcctgaccaacatggtgaaatcccgtctctagtaaaatacaaaaaattagccaggcgtggtggcatgtgcctgtagtcccagctactcgggaggctgaggcaggagaatcacttgaacccaggaggcagagattgcagtgagccaagattgcaccactgcactccagcctgggcgacacagcgagtctccatctcaactaaaaaaaaaaaaattctgctttgtggtcagggtcccatatcaccaccaaccaaccatgtagccgccctatcggggtaatgcctctgagcactggagggtcctccatttaacaccccctcccacaatatagacatgggggcatttgccaccatttgctatgtattcagaggtcccctgaagtccaaaatcaaggtgtgggcaggacaatgctttcactaaaggttctccagaaagatccttccttgtctttttctagcttcatttttttttttaattttttatttctaatttttgtggatattgagtaggtatatatatttatggggtgtctgagatgttttcacacaggcatgcaatgcgtaataatcacatcatgaaaaatggagtatccatcacctcaaacatttatcctttgtgttacaaacaattcaattatactcttttacttactttaaaatgtacaattaagttattagtgtctatagttacgctgttgtgctatcagatattagatcttatttattctaactgtttttgtacctattctttccctagtttctaataggggcagcaatccttggtattccttggtttgcaaccacatcactccaacctctgtctccattgtcatgcattcttctccctgcagatctctgtgtccaaatcacctcttcttgtaaggataccagtcattggattagggttcactctagtccagtatgatgtcctctgaacttgaatacatctgcaaagaccctatttcctaattaagtcattttcacaggtgccataggttaagatttgaacatatcttttgggaccacaaagttttaccctctgtagagctgtaagctgaggtcctatggagggaagaacccatggcatggatttggcattgttcccgccggctggagagggtacctggagaaggcagccatactccctcttgagtgaaggccctgggagtaggtgatctaagtgtccactcataatgaaaaccagagctcagaagactggaagtctaacccaatacaactgcttgccaccaaaaacaccctattctccagaggtctctgtgtcagccttttcccccagcacttccccagacaaacacttccctctctacctcttgtctactctgagtctctgtcatttggactttggcctctagattccccttcttctccagtctgccagccttccacccatatcagaggccaattctcctcttttccttctgtggccttttggtcacatgaaagagactagttaatactcaaaatctgagcccaaactgattgcccttcatcgaagttaggaactgctgtgctaataatgatgatgataataataataataacggactaatccacattcctggggtgaagatatttttcttccatcttagagaaagcccccttctgcccaggaaacatctggccaagtttctaatgtagcaaataaaaataggttgaaagtcacagcaatggaagttggaagttcctctgtccttcaaacctttgtcaatcagtgtgatcagtccctaaactctgtaatcttgtactggaaagtggtttcctgataggcctatcatctaattttaaataaaaaacattcactcgagactaaggattcagaaaaagtcgtctgcctcaacatgtcccaaactataacgtacatcagatcacctggggatctcgttaaaatgcagagtctgattcagcaggttctggatgggatttgagagtctacatttctaacaggatcctacatgatgatgctgatgttggtccccttaccacagcttgggtatcaagggtctacataagccctgtggaaagaggataattgcttatccagagcaatgtgtgttccagtcagaagaccacttgtaatgctgctctgttttaggcaatataggaaatcatccaagacaagtaaaaattaactcttgggcattcattgtattgtagaaagctaccttcttcatgaacaaaaagtaagggcttataaatatatttgtgttatcctatattggcagccatgccaaccaagtttctgccccacatatatctttatgaaaaactatattactagagaaataaagattttgtgatttcacaatagacctgattatggcagaaagtgggagaaaggttttatgcaaagttttatgtacatgcaattgcatttaacccttgctacaagccaacaggaaaagtgaagaaacagaggtcccagaaagttccctccaaaattggctctgagctccaaaattatttcttgaaacacattggccttcatggtctctgttaattgattccccactggtttttcatcattgatgctaaggcccacgttgtccatgtagagactcaatatgagtcaaacaaaaataagtttgcatccttgctgtctccttacacctcaacttactcccattaaggctgaagatattgtccagaccactccacagagctgatgggagactccacctaaggagaaactgccctgcagggcccctggagggagacactcaatgccaattcattttcccttcaccctacagtggaatcagaaggaagggatgacagaaacctaaaatcacccatcctggggtccccggagatccactgcccactcatttcctgcatgtgccaacttcctctccacggagtccagttacaaggcttctcacccatgacagcagggcagggagtggccagggctgaaataaaatagtgactaacttctgaataaaccaccggggtgcctggattgggacctccaccccatcctataactccctgacctcttatgggtggaggtggaggggaaatgaccaacagaaactgacttaagcatatctgaggtagctaaaaatgctaattccttcaaaacctgtacatggcatggttttccactgaagacctcagctctggaacctgatttagaattctggcattaccttttctaggtgtatgacctgaggcaaggtgaccctctctatacctcagtttcctcatccataaacctcataaagttattataaggtgcaaatgaattcatgtttgcacctacttaagtctttggctcatagtaagcattcaataaataatagcggtactattatttatgttttattaataccattgacagttccccctgccaatatagcttacctcctttttcctcataataggatttagagaatcagacactgttcaacactatagttgttgttttttctttaatcccctagtaagtacagtcagaatcccagggtgttcagttgaaataaccactgaaagtaaattccctagagccctggaacaggccagtcttggacagagtaataagcaggtctgatcttaaatgctaaatctcataggaatgtgtatgttccaggatcgtggtgttgagaacgagtccaaggtcctacttagattcaatggcaaaaacaaacaaacaaacaaagatgctgcgaatgactggtgatgaatgacatggctacatgagaaattcacaacaaacaaaatatgctactcactttgctttccatggtggtgtgggggacagagaaccagcctttgagtcaaaagagttagattcaaattctgactctgcctcttaatggaaggtccagtattagaaaagtaacctaacattctgggtcttgatccacttatttttacgagcagtggctgctctcattatgttatgaaaataaagctttagacacagaataaagaatagtagtatcaatatcctctctctcctccccactctcccattccccttcgatctttcttcctatctttttctttcttccttttttcctttcttcacactggctagtcttcccattctttctttctctgctttccctgttggcccgtgctcataaaatttcgccttggacaggagcacttcagcccttgccccagagcccatgtattgacccccagttccaaatctacaaaatcaaggaatcacaataagagtggaattccctaagcaactttgcaccccaaaatcaatcaatcagtaaatcagtttggtaaagcttaattcctcaaagcttctggtaggtattctggaaaagcgataaaccatttaatcaccaccactgattaagctccttctatatgccacccctgttttggtcattgaggatacagaaatgaaagagatcgtcttgtgctgaaaatgtggagtaactaaagtaccttagggactgatagcaggattgctagcagaggtcacagctgaattgacccttacaatttatttcagcagagcggtgagatagtatacgcaaggcacagggacgcccaagcagaaaaacatgaaatctcagaggtgtgtgcattctaccaccaccaattcccccttgaagtgccttcttcccactcctgcgaccaaccttccctttacccacactccatttcttggaataccctctatgctccatcccatgatccaggcttatgctcctcacactggttacctcccccaatatgagttacttagcctgtgtctactaatctctggtctaactgccatataatccaccaacccagttcagcgaatttcaaagaataacccaaagggaacacccatatcagaatctcttagacagcttattacaaatgcagtggccaatgccccacccatgattttctgaatcagaatggggaggaaggagtaaaaaaggagtctacatttccacaagacccctcattgactctactacacactcaagattaagaactacagatctccttcttgctgaggtgacactagctgataacagcctatccttcctgcgaatttactgagcacctgctataactgggcattctgtgagaacattttgcatatatcatctctttgaaagttattgtgttattaattggtgcactggtataagccaggcccaaatatttttaaatttaattctcccaacaactgcactgaacaagaatgaactctgtaaggcgttccttcttcttatatagtttgaagctggaaagcaacacaaatagctctgttgtgtacatatcctgtaccccagagactgaccttgtggatcgatccatccagtatgaacaaagagcagagaagaaagaaattcacccacagtgatgtgggttgagtgggcacaaaaggactcagatattatcccctgaactttcatttcagcctgtgagcctgtgtctttgacaaatgaaacagtcagataatgaaagagaatattcttagcaaacttctgcttctacatgtagggtatagggtatgagttatgctacagggttcttgactaagacagacttgagtttaaaacaaagctctatcactgttcgtatgtgagattttgagtgagtcaggtgagatacagatgatatgggatctacccaaaagggctttggggaattcaaagagatagtacatgcagcattttcaacacaaagtatcatgaggatgaacgtgggctttgtggcccccactctaatattcacacccagccacacttctgtctgtgctcaaagaatccccaagccaagacaccctgtgcattttagcagaacctcatcatctgctttctcttgtctttgtgttctcctgaagctcagaatttctcagcaggaaggtgaactgccagacaagaggccctcatcgcttggggatcatcatgaattgacagaaatccccggggagtgcccagcacagcattaagagggtttcaagagctggggacagaatgagggtgatggggaggcagctctcgctaatgggctgccttcagcctggctttatggaaattacaacactgagcctcacggacctgggcaagaggaccgcttctgagtgagtgggttggggaggggttcggctgcttccattgtggatggaagagcctggctgagctgaaaggggagctgagagatctgccaggatgggacaaagatctccttgcatttgccaacaaagcacatcctccacctccagccccttcatacacacaaacaccaccccgggttataagagtgatccttatccatgatgtcagggacctcacccacctcattttcctctctaaccatctcaaagaatagttattgaatgaatgaatgaatcaatgagtcaatgaatcaatgcatgaatttaaagaacccgaaggaccatcagccttgttttcagaagaaatctctcagttctgaaatatcaaatgggatggtcttctcacatatcgttgggaaaaactaaagaatattgatgccttctctttgagtgtcaagagctccatctaggacacttaagcatgttctttcatttaatctcctcctgacaactctatgaggtgtatattcctaccttcattttgctcaaaggagcctaacctgacacagagaggctaagtgacatgtctataatcacacaggaagaagtagcagggctgggttatgaactcatgatgctctgatgtcaaggctggtacttatttccactctgtctcctcaaggctctgtatattcctgtgaccatcttacagtcactgggatttattgtgtccttctcatctatttatacctcagaggaaattaaaagcatcatgtttttctttgtactattgaaccattttcacctaattaaagctagataaactctatccaatagaaatataatgccagctaaacatgcacgtttacatttcctagtggacacatttaaaaaattgcaaatagaaacaggtaacctcaagtttaataatatattttatttaacccattgtattcaaaatattgtcatttcaacatgtaaccaatacaaaaatcaaatcatgatgtaattaacattattttgtgctttgaaattcagagtgtgcttcatacttagagcatgtttcaaattaagccacatttcaagttctcataggcacgtgagcctggtggctgccatattggacagagaactcttatagggataagacatgggatccatcagcatcgaggagagaaaggagaatagaaggggcctgcagcactgctgctggtattctggtctcctagcccctcctgcagtgctcttggatagaaaaaaatctgcgaggtggctgccgcagttgcaggctgcctgctattcacattcctaaaggaagatcagagagaatccagagatgtcacaatgctgggtcacatccatttccccactggagtttctaatcaactcaagaggcctataatcctggctgagctcctgccctgggagggcctagtttgtccctgtgtggtatccctgtctctccttcttcaggtctgagaacctgagaagattcccctgggaacccagcagcataggcagtcaagtggcccagatcagtaggtgggctgtggactggggatcctaggacaaatccaacaagcaagaatccccctccaccctccatggggcacagttctccttgctggggctttctgccaacactactatccttgctgctcaggaacaatcattggaactccacactggaagcttctacttgctcctatcacaggccaggctgggccccacctttgagtatccgcagctacacatggaagcctgccaggttaagctgagcttggcacattgagcctggaaccaccccaatgctttgttggagaagggaagtgcccaaggcccatttgctgagctaccattcattcccaccaggcgcttggcaactgtcagattaataacagtgactgaataatgtttcctgagcacttactatagcccaggctggagcaaagcccttaacgtggattaccttgttgaagccattctccatacagcagcctgtgtgagctttatgaaacacacaattaatcgtataacccccttgctgaaaacgatgaattcccactgtgcttggaataaacagccaaatccttaataaggctcctgaggctgcccagacccttacagtctctgcagctctgtctggctcacactcccccttctccctggtctctgacagtgctcacccccttggtgttactcacaatcattgccagctgatgagccgacttggcagggctgggtgtgggcttgtgctcactctgagacagtggcagacgtttgtgggctgtctctgatattgactggcagcccccacctccttggttgtcatccagggtggaaaacactccaaagcggccaattactattcactgtgacttcacacacaccacacaccacacatcagtgcagacgcacacccagaacactgctctttcagcttttaagcttcttcaacattgctcatgctgtaaattaccagaaatttgcagtggattatcccagttagtatatttcccatctacaggcagtatcatcaccttgctggccaacagaagagcccacccctgtgaattaaagggactcttgcttcccaggacctagagaagcttgccctggaagaaacgtaatgattcctactctcacctgcacagacaatgctttcactccagcagcctcatgaaacagccagctaatccatagtccattgtgatgaccacctaacagatgggaaaattgttgctcagagataggtaacaacttgctcaaggttatatggtcaagaagcaacagaattgtgctttgcctatgtgttggcctttgaaggaaaggtcaggtctgggctgcagaggctctattgtggggatgagcctgtaaacctgagccccagcctcctgcagagctgtagggggctgcagtgcccagaggctgaggattcacttctcaaccttggctaccagtgagagagcaggctcattctcctctccagaagacttttttttttttctataccccaagctgtgactttagtgtccatatcatcccaccaaagacctctcaagccacactgaagagaagatgagttccagggtaggcccccctcagaagcctccaaggccatcactaagtgctgtcctctccatcttcaagacatttcccgtctgattctttctgcccttgcctttgccctgtgccctagctcagggttcagtgtcttttacctgggctagtgtcccagtccctctctggcctccctgccttcagcctcaccatctccagtccaccctggatggaggtttcaagagagaagtttctcctggtgattcctgcttgtacctcccattccgaccttccctattccctccagcatgtgtctcttaaatgaaacccttgtaactgaacctgccccttctacccagcccatggtgactcctaacaaagttgtaataatcactctggtgttcccatttgctcctcacatctgctaatgcagggcccatggtctagtaagaccctgagactccagactctgcttccctgcctcggagaggacactttttgagccctttccctgcactcactcccatcacctgtatccctgtgtctcttttcttcctctgatcacctgtacagtgtgacctaggagctggtgcaaacaaagattcctgggccctgcgccaggatgctttttttatgatatatatttaaggtgtacaacataatatttgatatacatatacagagtgaaattgtttctacagtcaagtgaatcaacatatccatcatcctgcagttattttttaaaaacctaaaatctactctcctaggaaatgtccaatctataatataatattgactatagtgtccttatgctatacattatatctctacacttacttatcctgcataactaaaactctactctgtgaccaccatctccacattccacaccactcccagcccttagcagccactggtctactctctgtttctatttgaatgttttgttgttgttgttgatgttgttgttgttttaagattccacatataagtaagatcatgtaattttttctttctttatctggcttatttcacttaagcacaatgtccactagtttcatccatgttcttgcaaatggcacgatttcctttttaatggctgaataatatttctgtgtatttggggtatacatattttatatatattcacaatgtctttactcattcatccattaatgggcacttaggttgtttctctatcttagctattgtgaataatgctgcagggaacatgggggcacagatatctttacaaggtgctgattttatttattttatttgggtgtatacccacaagaaggattgctgggttatatgatagttctatttctaatttttttaggaacctccatattgttttccatgacagctgtaccaatctacattcccaccaatagtatgcaaggactctcttttctccacatccttgttaaaacttgttacctcttgcctttttgataatagccacttgaacaggtgtgaggtggtatctcactgtagttttgatttgtattcctgatgattcaggaagctatgtttttaacaaactcactggacaattcacaagtccttgagatccatgaagtctgagaaccactaacccacaagcccttgtcatgggatatggcatgatccaccttggggactgagggcgactgtcttttccctatgtgctcttgaaaggccacttcagctctctgcccaggagccctctcctcctttatcatttacgaaatgtctccccttcctccctggtgcagcttacttgccactttctccaagaagtcttcctgggctccacaaagctgagctgctcatgccctcctctgtgtacttaacaggaatctgctttttattctgtgatgtgtcccaacttcctctgtgacctggagatctggagccatccagacagggtcttccactttagatgaaatggaagggtggggagaagggcaaataatggcctgaaaagaaggtggcccttcctgatcatccactacacatgttcacattcatcaatgactttgttctttcctactaacctataaggctggagctgccattcaggttctaacaggcgaggacactcaggcttgaaaagcacaatatggaggctgcactgctgataaatggcagagctgggcctgcacttcagctcctctggactgcagagacactgttaaggcatcactctgagaactggagacagtggtcataaaacggctgatgacaacctaagaccttgattcttctgctgtgcattttcagtccctgagctcccctctctgtgggcagcacatgcatgactctgagccaagcctttgacccagggtgatgctcatctgaagcccagcgtcaccatcataagtgtgggagccattctccacttaaatttacagacctgctttatactcccacagaaacgcagtcagaaaatgaccctcacaccaggcatccatcagaaatctgtgtgtaatttgtctttattacgaggaagaaagggttggcggagaggcgggtgggaggtggagggggagaaatcaatttgatgtcaggtttcaattgttgagttactaatctaatcagtgacaacttacccttttagatgtacggcttggctttccaaaaattagaaatatcctctttttccaaaaggctgttggaaaggagataattaccccaatacaatctgtgcttattctcagagttgtgttttttttttctttaaacacgacaacatttcctacatgtgttcagtgaagctgaaaatgctattttgataatgggcccacagaacgtttaacaggcctggatgacaatgtgagactttcttaaggaatgaggaggcaatgaaaagctattataggagtcattaatggggactgggaggtctgctggagacatcactgcaattctcagttttgctgttttcttaataaggttctttggagatcagatctgaagcatgatcttgccaaaacccagagccctcagccctgtccttactcaacctgaccctcccagctgccaagattgaaccctcctccctcaacaccctccccatttgataaagattgactaagcacctaccatgggccaatttccccattatgtgctggcagtgagttgaaaacagtctttgcgcctacacttcacagccccagaggaaggcagataaaaaaggagagccacaatcccacatgatgtgttccgtgatggggtagctctgagagagcagaaagtggggagcagctacagttcctggtcttaaaagatgagtagaattttcttagtgtgagaaactgagcctcattaatctggcttcagtcccacacccatccctgaactgaggcaagaagtatgaaatatgatctgattggccacatggtcacatacctagccttgaaagtgacaggagagtcaacccctggaaaaattcattgacttaaaataggggagaggtggttctccatagaattaggggagaaattctgttcccggaagcagagggagtagatactgaacaggctaaactagcagctgtccactaagcaggcaggcacctgttactgccaacagaggtcatgccatctttcagctctgcagctacaaaaagccacaactcctggaacttggctccaaaaggagttactttctatcaagccagtctcaataaccctccatttccagttctccccagaataatggggagcttgcacctccaagagtgtggacttggttgtcctttcagcaggaagagaggctaaaattaccttgtcattcatcctggtttcctagaataataaaaaaaagaaaagaagacaaaatggagtatctcaagaaactctccacctgcattaaacaacaagccagggagaacatgttactctggagaagtatctaaaagtctagaagccctgaaaatggagcaattcattttgttaagaaatgggtgaagaatcaagtaaacttatggagaggaggttatgctaggagctaggctatcatcctcaaagaaatgaatcctaataaatggcccacattcaaaaaattgatgagcaatttgctttctcatctggttcttgggagtatgcaaagtacccatgcacatgtgactttatgttccaaaaaagccccagaattgggaaaggttgcatttgataacaagaaaacctgtcccaagagatcaagcaaattccaaagtagtttttaggggtggcaatgtaaaccataaccaaggggacccattagtgtcaactgtattcaaaggatcataatgagatggaaacaactgcattatccagccagttgaagtcaaaattcccccgagggaagggctatctttgtatgagaaaaccatgataagtccctcttaggtccagacagctccttaaaggacgggggttgtcttgcttgggataaaagaaaaatgtactgacttccctcccacaacactgaggagggaagaagacaaactagagaagaaagagagagaagaaaaagtataggaggaaagaagagacagtccagtggatccacagctagtgaagatgtgcaatgtgtacaaatcatttggaaaatgggtatcttcttatccctttaaattagtttgttcctgtgatggaaacccttcctccattctgagtttgattgaagcacatggctgtgttttccttgtggttgttttggtttgtacgtcagttgattttgtttggtagaaagatgtgaagaggctatatctgacacctaaatcagtgtggctcaaaacaaggattgcatattagagatcagaaaaattatgaaaactcagggagatcctggagaaggccacagaaatggatatttgaggccatcttatcccaatcccaaggaacagggaggctgacaactgggctgtaaaattcaaaaatcaagaataaatgaattacatttatttcaaggtcttttccactgtaatataaaatatcttttgacaaatctgggtaacttctatcctttttttgtttttttagataccagacttcttagcacctttaactttttgcatgcaatcggactctccaaaacaccttcttcattctgagacaattatctctgtcttgcgttattctatttcttataccggtaggttttctatagaagcatttttcaaaaaccttattgtaacatctctgaccattttgcatgtgtccttatgccctacagatctggaggaaattaggaatgtggaaaagccacaggtggagatggagagaggatgttaagagagcctgagaagaaagtgggaatttgatttcacagggtatgtgacagcctagcccctgagctccaagtaagcaggaatcctatccgccttattcgtcctcatccctatgtcctcaggacccaggaaaattgctggtgaaatgcataggtgctcaataaatatctgtcaaatgaataagtgaactcttcagagctccgtgaattaagtgtatgacctaagaattaagtatatgactctatgattcatatcaacatagaaactaagcctctaaggagtcaggtggagttctccaaatcacagaatcacagggccaggataggaatggaagaggttttggctgcagagcctgcattattttcagcctcacatactactctctcttcctacttcaagagctatccttctgatcacctttgcccccagctttctgtttctaaacagtgatttaatcctcagcccattgcaacatttagaacggtggtcctccaccattagaaggtattagaatcatccagagctgaacaaacaaacctgaacagttgcaggtttctgggattcaatcccgagaaatactgattttgtagtgggctccaccccccaaaatactgatttcatgggcctgaatgagactttggaatctgacttaacctgggtccattgcaggactaatcccttcatggagggaccattttagtagcccactcagcttcctgcagatccctttcttatttttgtgtgtcccttggagcctatgatttttttttaggggaccacctttgtgctacttgagctttgtgctactctgaccacatttacaaaaatccagaagttcctaggaaattatgttctactggaaacttttaactattgagattcgagtgaatttttttggaaactcaactcccttacttcaggtcaggacacttctgaggtttaacttacactccagtttccctgtgggatcaggctgaagtcaacttccacaggtctgtgcctgagatcatgcccttgcttggcttccaactcttcccggtctaattttcaccttccttcccagctttcctttcctaagttacctgcaaatgaatcctcatctcagaatctgtttctggacagtcaaacccaaaacacacttcctgtctttagtttttcattgcttatattctaccctgcccaaacttggtcttccagaaagttgaatatgaacaattcaactcaaagtcaacacaatgtgaagcttaaaagtaggttttcccctatccctgaagattatacctattttgagctgaccatctttgaaactggtggagtcaggctagagagtggaaggaggtgtgcctctcttccaagggacaaaaatcttatacccgatactaagggtcagaagactggactcttaattgcttttggagggtgatgcaagatcgaggccatctccttccatgagagctccccttctatctgaccaacctgaagccagacccatctgcatagacctcactaggtttcacccctatttttcctccttacccctgtagaaatgcacatgacctctttatgaagaccccaaagttcatctgtcattattttttgcattttcaaaaaataatagaatagaaaatctatctatttatagggaactgcatgactgtgtgacacatctccctgttgtgaaatccaagctactgtcataaaacatttagaaacaaaaagggaagagaggagtaagatggtccaaagaggaagctcttgctatgtatttgcatttctatggaaacagtcttgggcagacatggctttggtcctctgtggtcagaggaacatgaagtcaggtgcctggcagctggtcagaggctgctgcagcagcaatttgcaggggacagaatggcataagagaacagacacccagaggcctccaaatctcctaataacagggaccaggaacttgtgggtttatctctctaaatgcccagctagtcctgtggcaatctccctccatgtgcacttgcaagtgggcatccttgccattttctccctccccctaaaagcactgtgcaaaaaaacatgagatgtagacaacagagagagaagacagatggactgctataagaccagtgactagacgataaggagaataacattttatgtttattattaacaaatagaacaggtacagttgccgccagtaattaaaagatggttatgcattagcagtctcaattattcaacttagtagggaaaaaaaaagaaaaagaaaaagaccaaaaaaaaaagacgactattttggaaactgatgaaaaaaacagataacaagagtcaacatacattcctcattaggaaaacaaaaagataaacaacccttgttaaagtaaaaataggaaaaaatgttgactatgataatgctaccagagtttgacaacaaaattgtaccttattaaaatataataaaatcattcccaatgaggcaaaacagtagaaaaagtagactgacatcattatagtttattattgttctacaagttctagtatccacaataagataaggaaaaaaaagatgtttaacttttaataaagcaaagctaaaattgtccctccttgcagatgaatttatctgtatggagaaatcaaaaagacttaactaaaaaaattaatgggattttaagaaaagtagaaagatatatgtttaatatacacatatgttgaatgcctgctgcatgcctttgaaccatggcatatcattttaattctcattcacactggcaagataggtctaaccttctgatcctacagatgacacaattcaaatctggagaaatttagtaccttactcagagacggtttctaactgctagaacatgaacccagtaatgactttcttacagctcacattcttcatatactagcccagcgtgattattactattaatatgttactatatgaacaacattaataatagcttaaaaggcactctttaataagtacgtcttatatgcatgcattgcactatgaatgaatgaataacctctttcctcccaaacaacagcaaatgttcctcaaagtttccacggccaaaatatacttcttcaataaataaaattttaaaaccatcaaattaattgctttctctaaatattattaatcatatgtaatctatgagcagagaggcatatcatttggaacaagaagtgatacaaaaaatgaagaaactaaaatgtatagggagagtgacatcagcaagatgacagaataggactttccagcactcatcccctaggaggaacatcaatttggacaatttatccttgcacaaaaataatttcataagagctaaggaaacccaggtgagagattacagcaacttggagtagcaaagaaataagaactgacacattgaagaggctaggaaggacagcttcacattatctgagtcacccctcccttaagcctgggcagcacaacatggagagataacctccacatgtgggagggaaagtgaaataagcacctggctttgctacaaaccccagcaccaggccagcttcaatgaaattcagcactaggccagcctccacagccccagactctaggtcagcacccatggatcatgcctccaggcctaccctactgtcagaccagacccattgctccaggctccaggccattctctacagccccataatgacacccaaggacccaccttctaggacctcctcagtgccagaacaacacctgcagatctcagttctaggctggcccatgaagcctcagacgtctggctggttccagcagccccaggctctaggccagctgccataaccccaggctccaggtcagcccctgtagccccagactccaggctggccccagtggccccaggcactagaccagcaactgtagacccagaaactaggttcactcctgcagactcactttctaggcccaccccagtaccaagccagccctgcaaagactcaagttccaggactatctccacgaacccaggtggcaagtctattccaacaaaaggccatcccctgatgactcaggctcaaggcccatctcagcaccaggctggctcttatggacccaggatccaggcccgatccccatacactcagctttaagcaggtccctgtggacccaggtaccagacctgcacacattctgacccagacaccaggccagcctgccctaggactctagcagcaaacccaccactgggacttacaaaatggtcaactcagaatctcagaactcaacccagactggagagttttccctgccaaagccaatctgtaaaaactggaataggtgcctacttctttgaacttgcaatcataagacatggccagaagggtaaaaaaattatctgtgaaacatgacaccaccaaatgaacaagataaagcactagtaactaaccctaaagaaagggagatatgactgcctgacacagaattcaaaataactgtcttgaagtccagtgagctacaagaaaacacagacaactaaacataatcataaaaacactacctgaacaaaatttgaagttcaacaaatagaaaccataaaagtgaaccaaacaaaaattatggtgctgaagcatacaataccttaacaggaaaattccacagacagcttcaacagcaaactccatcaagcagcaggaaaaaaatcagtgagataaaaacaggtcatttaaaattacctagtcagataaacaaaaagaaataaaaatgaaaaagaataaagaaagcctacaaaattatgaaacaccatcaagtgaaccaacatatactttacagaattctcacaaagagcacagaaagagaaaggagaagaaagcttatttattaaaaaaaaaaagatagaaaaattcccaatctgaagagggaaataaatatctagaatcttgaagcccaaagaacccaaaataaatcaaatataaagagatcttcactgaaacctaatcaaattctcagaagtcaaagacaaagagaaaaattgagaagcaacaaaagaaagaaaaattgtcacatacaagggaatcttattaaaaccaccagcagatttctcagcagaaaccttgcaggccaggagagagtgggatgatatatacaaagtactgaaagaaaacaactgtcaaccaagaatactatactcagcaagtcttcagaaatgaagagagataaggaggtttccagacaagcaaaagttgtaggagttcatcattagtagagctgccttacaagaaatgctaaagtaagctcttcaaattgaaacaaaagggtggtaactagaaacatgaaatcatttgaaattgtaaaactcaccataaaaataagaatgcagtggagtttagaatactctaatactgtaagggtgatgcataaatcactttttaagtctaatataaaagctaaaagattaaagtattaaaaattgtggtcattaaataatttggtaatggatacacaatatataaaagaggtacattgtgatatcagtaacacaaaatgtggggagatgaataaagcatagagttttgtatgcagtcaaagtaaagatgttatcagcttaaaatagattgttataactacatgatgttttatgtaagctttgtgttaaccataaaaaaacctatagtagatacacaaaagataaagagaaagcaatcaaaggataccacaaaaaaaaatctatcaactctaaaaggagggcagcaagagaggaggcatgaaacaaaagaactacaaaatagtcagaaaacaattttttaaataaccacagtaagtccttacctatcagtaattactttaaatgtaaatggattaaattctcaaatcaaaaaatgtaatgtctaaatagatttttaaaagcaaaatttaactacattcttcctataagatactcactttagcattaagaaaacatatagtctgaatgtaaagagatggagataaaatattccactcaaacaatcacctaaagagagcagaggtgtctatattaatatcagacaaaatagattttagtcaaaagctgtcacaagagacaaagaagatcgttgataaaagggttaaattatcaaaaggacataacaattgtaagtatatatatacacatatctacatatatatacatacatatatacatatatgtgtgtgcgtgtatgtatatatatacatacccaacatcagttttctctgtctgaaatgctctaagctgacttgaacagacatttctcaaaagaagacagacaaatgattggcaggtatatgaaaaaatattcaacatcattaatcattagagaaatgcaaattaaaatcacagtgaaatatcacctcaaactcatttgataatggctattatcaaagagacaaaagataacaaatggtgacaagaatgtggagaaaaaggaaccctttatactcagtgacaatgtaagttagtataaccattatggaaaatagtataaaggtttctcaaaaaaaaaaaaattatcatatgacccagaaatcccacttctggatataaatgaaaaggaaataaaatcagcatgttgaggagatatctgtactcccatattcattccatatctttgctattactcaaaacaacccgctgattttacagccctatggccttgagtgaacataggcagtaaccaggtcgtggttacagtggactttgggtgagacctggtgctgtgttggcttcaagtctgacctaacacagcccccgttgtggtggctacaggggcatgggtattactggctattattgggtattattcatagcagccaagacatggaatcaatgttaagtgtccattgatggatgaatgggtaaagaagatgtaatacacacacacacacacacacacacacacacacacacaatgagataccattcagcctttaaaaagaaagaaattttgtcatttcagacaacagaggaaacatggataagcctgaaggacattagattatgctaagtgagataagccaggaacaaaagaggcaaatacatgggccttaagtgagactctgagatgctttggggggaacatagcccatccctagctgttgtggctatggggaaagactccatctgcttgagaaaagtaaaggggcatttatcttgcactttaggtaccagctcagtcacagtggagcagagcaacaggcagcctcttggggtctccagttctaggcattgactcttggatggtatttctagacctgctctgggccagaggggagcccaccaccctgaacggtgagtcgcaggcctggcaacattcaccacaagctgactgaaaagaccttggcccttaaggaagcatcagtggaagcctgccagtaatcctcatggacctgtggtgctggtggccatgaggtgaggcttctctgtctatagaaaggggaggaaacaatgggaacgactgcatcttgtgttttaagtaccagcttagcagcagtgcaagagaaaccaggtagatgtctaggattttttctgtagtctctagccttttctctagtcctggatggcatctatggaccaattcaggggctagcggaactcactgccatgaagggaaggatacaagcctgtccgtcttcaccacctgctgattgtacagccctcgggccttgagtgaacataggcagtagccaggtagtggttacaatggaccttgggtgagatctggtgctgtgctggcttcaagtctgacctagcccagccccagtggtggtggccacagggatatgtgtgtcagccccttccagttccaggtggctcagcacagagagaaagagacactgtttgtacaggagaaggtaagggaagagaagactttctacctgataatccagagaattcttttggatcttattcaagataatcaaggcagtacccctatgagtctgcaaacaccacagtgttactgggctttggggtgccccctaatgcagatacagcttagatcataacactcaagtctttccaaatatctagaaagcttccccaagaaggacagctacaaataagcccagatagtgaagactacaataaatacctaactcttcaatgcccagacactgataaacatctacaagcattagcatcatccaggaaaacatgacttcaccaaacaaaccaaataagacaacagggagcagtcctggagaaacagagatatgtgacttttcaggcagagaattcaaaatagccattttaaggaaactccaagaaattcaggataacacagagaaggaattcagaattctatcagatacatttaacaagcagattgaaataattaaaaagaatcaagatgaaattctggagttgaaaattgcaactgacatactgaagaacacatcagagtcttttaatagcagaattgataaagcagaagaaacaattagtgagcttgaagacaggctatttgaaaaggcacagtcagaagagacaaaaaggaataaaaaagaatgaagcaagcctacaatatttagaaaatagccccaaaagggcaaatttaagagttattggcctttaaaaggaggtagagaaagagataagggtagaaagtttattcaaagggataataacgagaatttctccaatctagagaaaggtatcaatatccaagtaaaagaaggttatagaacaccaagcagatttaactcaaagatgactaccacctgccatttaataatcaaattcccaaaggttaaggataaggaaaggaccctaaaagcagcaagagaaaagaaacaaatgacataacaatgaagctccagtacaaccaaccaatttgtttcaaccagtgaaacaaatgacataacaactaagctccagcaaaaaccttatgaaacagcagaaagtggcatgacatatttaaagtgctgaaggaaaaaatgtttaccctagaatagtatatctggtgaaaacatccttcaaacatgaaggagaaataaaagctttctcagaaaaacaaaagctgaagaacttaaccaacaccagaccggtcctacacgaaatgctaaagggagtactgcaatccagaagaaaagcacattaatgagcaataagaatttttctgggctgggcgctgtggcttacagctgtaatctcagcactttgggaggccaaggcaggtggattacaaggtcagcagatcgagaccatgctggctaacacagtgaaaccccatctctactaaaaatacaaaaaattaactgggtgtggtggtggacgcctgtagtcccagctacttgggaggctgaggcaggagaatggcatgaacccaggaggcagagcttgcagtgagccaagatcatgctactgcacttcagcctgagcgacaaagcgagactccatctcaaaaaaaaaaaaaaaagaatttttctgaaggtacaaaattcactggtaatgttaagtacatagaaaaaacacagaatattataacactgtaattgtggtgtttaaactcatcttaagtagaaacactaaaagatgaataaatcaaaaataataactataatacaacaacttttcaagacataagcagtacaataagatacaaatagaacaaaaagtttaaaagtgggggaacaaagttaaggtgtatagtttttattagtttccttttggcttatttgtttatgcaaacagtataacgtttttatcaggttaaaaaaatgggttataagatagtgtttgcaagcctcatggcaacttcaaataaaaaaaatacaacagatacagaaaaaataaaaagcaagaaattaaatctaactaccagagaaagtcaccttcactcaaaggaagagaaaagaaagaaaaaaaaggaaagaaaagagaaaagaaagaaagaaagagagaaagaaaataaaggaaaggaaaagaaagagagagaagagaaagaaagaaagaaaggccacaaaataaccagaaaacaaataacaaaataacaaaatgtcaggagtaagtatttacttatcaataataacattgaatataaatggactaaactctccaatcaaaagacatagagttgctgaatggataagaaacaagacctagtgatctgttgcctacaaaagcacacttaacctataaagacacacatagactgaaataaagggatagaaaaggatattccatgctaatggaaaccaaaaaagagcagaagtagttacacttatatcagacaaaatagatttcaagacaaaaactataagaagagacaaataaggtcactatataatgataaaggggtcaattcagcaagatgataaaccaattgtaaatacatatgcacccaacaccagagcacccagatatatagagcaaatattattggagctaaagagagagatagactccagtacaacaatagctggagacttcaaaaccccactttcagtattggacagatcttccagacagaaaatcaacaaagaaacatcaaacttaatctgcactatagaccaaatggacctaatacatatttacagaacactttattcaactactgcagaatacacattctttccctcagcacatggatcattctcaaggatagaatataggttgggtcacaaaacaagtcttaacacattcaaaaaaattgagataatatagagcattttctctgataacaatggaatagaactaaaaatcaacaagaggaattttggaaatgatacaaatacatgaaaattaaacaatatgatcctgaatgaccagtggcttaataaagaatttaagaacaaaattgaaaaatttcttgaaacaaatgatactggaaacaacatatcaaaacctgtgggatgcagaaaaaatagtactatgagggaaatttatagctataagtgcctacatcaaaaaagaagaaaaacttcaaataaaccacctaaggctgcgtcttatggaaccagaaaagcaagagcaaaccaaacccaaaattagtagaagaaaataaataataaagatcaaagcagaaataaataaaattgaaatgagaaagaaatacaaaagatcaacaatacaaaaagttggttatttgaaaagttaaacaaaaatgacaagcctttagccagattaacaagaaaaaaagagtgtagacccaaataaataaaattagacacaagaaaggacacaatattcaactgataacacagaaattcaaaggatcattagtggctactatgggcaactatatgccaataaacttgaaaatctagaagaaattgacaaatttctagacacatacaacctaccaagattgaaccatgaagaaatcaaaaaccagaacagaccaataacaagtaatgaaactgaagtaataataaaaacatcttccagcaaggaaaagcctgtgactcaacagtttcacagctgaatcccaccaaacatttaaagaggaaataataccaattctacccaaactattctgaaaactagaagaaaatagaatacttccaaactcattctgtgggactagtattaccctgagaccaaaacaagacaaaggcacaccaaataggaaaactataggcccatatcactaataaatgttgatgcaaaaatcctcaacaaaatactagcaaactgaattcaacaacaccttaaaaagataatccatcataatcaagtgggatttatccctggaatgcaagcatagttcaacatagacacaaatcaatcaatgtgatacatcataacaacagaatgagggacagaagccatataattatttaaattgatgctggaaaagcatttgataaaattcaacagcccttcatgacaaaaaccctcaaaaaaaactgggtatagaaggactatacctcaacataataaaagccatatatgacagaccttcagctagtattacactgcatagggaaaaactgaaagcctttcttcttcaaagatttggaacacagcaaagatgctcattttcttcactgttattcaacatagtattggaagtcctagctagaggaatcagacaagacaaagaaacaaagggcatctaaattggaaagaagtcaaattatccttgtttacagatcaagtgatcttatatttggaaaaacctgaagactccaccgaaataattagaaatgataaacaaattcagtaaagttgcaggatacacaatcaacagacaaaactcagtagcattttatatgccaagagtgaacaattggaaaaagaattcaagcaagtaatcccatttacaatagccataaataaattaaatacctaagaatttgcttaaccaaagatgtgaaagatatctacagtgaaaactataaagcactgatgcaagaaattggagaggacactaaaaaatggaaagatagtccatgttcctggattagaagaatcaatattgttaaaatgtctatacttctcaaagcaatctacagatttaatgcaatccctatcaaaatatcaatgatcttcttcacagaaatagaaaaaaaagtttaatttatatgaaaccacagaagacccagaataaccaaagctatcctaagcaaaaagagcaaaactgaagtaataacattaataacattatctgacttcaaattatgttgcagagctatagtatccaaattggcacggtagtagtataaaaacaggcacataggccagtttaacagaatagagaacccagaaataaatccatacatctacagtgagcacattttcaacaaaatttttgagagcacacattggggaaaggacagtctcttcaataaatgttgctgggaaaactggatatccatatgcagaagaatgaaactagactcctatctctcaccatataaaaaataaaaatggattcaagacttaaattcaaggcctcaacatataaaactactaaaagaaagcattggggaaactccaggtattggagtgggcaaagaagacttcttgaataataacccacaggcacacgcaaccaaagcaaaaatggacaaatgggatcacatcaagttaaaaagtttctgcccagcaaaggatgcaatcaacaaagtgaagagatgacccacagaatgggagaaaatatttgcaaactacccatatgacaagggattaataactagaatatataaggagctcaaacaactctagaaaaaaaattaatcatgtaattaaaaaatggacaaaagatttgaatagatatttctcaaaagaagacatacaaatggcaaacaggtatatgaaaaggcactcaacatcattaatcatcagaggaaaaaaatcaaaactacagtgagatatcatctcactccaattaaaatggcttttatccagaggacaagcaataacaaatgctggcaaggatgtggagaaaagggaaccctactgctggtgggaatgtaaattagtacaaccactatggagaacagtttggagtgtcctcaaaaaactaaaatagagctatcatattatccagcaatcccactgctgggtatatacccaaaagaaaagaaatcagtatatctaagagatatctgcactcccatatttgttgcaacattagtcacaataagtcataatttggaaacaacctaattgtctatcaacagataaatgaataaagaaaatgtggtatatatacacaatggagtagtatttgaccacaaaaaaatgagatcctgacatttgcaacaacatgaatggaacaactttcatcatattaagtgaaaaagccaaacacagaaagacaaacattgtatgttctcagttatctttgggagctaaaaattaaacaattgaactcaaagagatagagggtagcaggatggttatcagcaactggaaagcgcagtgggcttgaggagtaattggggatggttaatgggtacaaaaaataaaaagaactaataagacctagtatttgctagcacaacgatataaaaataatttaattgtacatttaaaaataactaaatgagtataactgtactgtttgaatcacaaaggatgcatacttgagatgatgagtaccccatttaccctgatgtgattattatatgttgcatgcctgtgtgaaaatatttcatgtaccccataaatatatacacctactatatactcacaaagaattaaaaataaaaaaagttgaaaaaggcaaatacattattatctcacttatacatgaattctaaaaaagtcacactcatagaagcagagacagtagtatagtggtttcagaggctggtaacaggtcaaagggagcagaaatgggaagacgtttgttaaagggtataaagttttgtgaggataaatacattctggagatctattgtacaacatggtggttttagttgataataatctattatatacttgaaaattgctaagagagtaaattttaaatgttcacaccacaaaaaataagtatgtgagatgatggatatgttaattaactttaaccatttaacaatgtatatatacatctatcaaaacatcacatcatacactgtaaatatacacaatttttatttgtcaataatgcctgaataaactgagaacaaaataaaaatgaaaatatgttaccctaaataatttaatctaatttaatttgtagatgctttacctgatatccctaataaattttcaagccacatattatttttattgttaaaataaaggaggttgagaaggataggaagctttgtccaaaatcccatagttggaggcaagatacaaacccagatctatctgtcacctcctgctttccttccggatttagacttcagttttctagtcaattatctcaaacttatctcacagggacatactccagcagactccaggaacccattcattcctagagtaaaattgagtgtttggcctggagaaaatgggagatcctttctccacacaaaaacatagctacccaaaaccatatcatcagggccaagtgccttttatggagcatttaccattcaggcactttaccagacaacctcaatttatactcacacagcagcccagataaggagatactgtcactatcccccttttgccattgagaaagctaaaactaagagaggagaagtgatttgcccaaggtcaaacacttagtaaataggagaaacaagattctcatctagagctatctgaagtcaaaccaattcatccagatattccattgtaatcttaaatgctagggcaaatgtgctcacaatgaacttccaccctgcctctaatccctgcatcatgcaaattcttaagatttacctccaagaagctctggttcacagggctgggaaagccccaagagcttaacaaatataccctgtgactgttagattcattaactgtgagacccctaggacttgagagttccactggttgggctgggatttagttacaaagaccccatcaccggacaaaaagcaagttaagtccactttccttttctctggaaataacagacttttgggttccctgtccatatatggccagatcatgtagtctggggacaacatacagtagaatggagtatctactgtgcactgactctatcttggaagatggtctgtctcaagaaccagagacatgagcttgtgcctgtgcaaggaagtgtctggtcacttttcctactcagctatgacagccagtgagataggttaataaataggcagctccaaagaagttaggataagaagaggaaggaaatagttttccctagagctggagtgagctaccagcctgtatcaaatgtgccctatttatttggcaagttctgctgataaacaaccttgtccgctctctcctgctgaggaattcctgatatgaactgtcaaacatccacatccttcctgtaatccacctcctgtgtgaagcagagatttcttctggaagtaaagccaaccttgccatctcggctgccaggttggcattagaatagtggaatcttgtaagctgcaaccccccctgccccgcaaccagagagatgccaccatgttgtgctgggtctgctgtttccagcaaaataagcacatgtgtggttcactgccttccctggaatgtccgggagcaggaagaaggggtcctcctgccagactccctagtttcactctcttcgcttctctggaaaattttatctcatggaatcttgtaccttgctttcagaatgaccaggaatattctatggaagcagaatgttaaggaagatataacgcatgttggtgcagagaacaccagtctctgaatgctggacctttaaaaccttgtgagtacacagcatatctgtagaaaagtctacagtggcaaacacttcttgttgaactcttgtatttctagttagtgatgattcccaactctgcctaattgatctgtctagagaggatggcagggcttcaaatctaaaagcccagttaaaaagccctgagataaaacctccccccaaaaattacatgccagatacctatatactgattttttttatgaaaagctgatacccacagccctctataacagtactgtcttcccaaatataccttgctctcagagaatcagggttgataatatatgtcagggtgggtggagaacagatagagcctgtttgtacagtgacagtgtggctcattcatttattcatgcagttactcaaacagcaaatatttattaaacaccacatgtgagcaagaacatctattcagcacaatgagggtgataataggggatgcagaattgttgttgggtcacagaggcaggcatctaatctagcctagctgtggggaaacaaggatgccttccccgagagggtaacacctaagctgagatgtggaagatgagtaaaaacatgtgcaaaggcgtagggactgaatctgaggaacgtgaagaaattcagggtgactacaaggtagcagttgctacattaagaaaagtctcattaactaagcaaagcacgtactacatcagattgagccctatggggtgtcattgagatatttttagaagggaatggcatgggaaaaaaatggagatttacaaaggctcacctggctgcagtgtaaagaagtgatggacagggtgatccaggtgtcaggggagcctgttgagaaggctttgcagtgacctcagacaaagataatgaaaggcacatctatgtgttgtcagtggaatagagagaactggatggattgtgacttatttaggagataccatttaaaataaaacttgtacatataaattatttcaattttagatggtgtggtacactgagtagtggcctcccaaagatgtccacatcctaattcctggcatctgtgaatatgttgttttatatgatggaagagatcatgaagatgtagttcaattaagaaccttgagatggggaaattatcctggattatccagtttggcccaatctaatcacaagtgtcctaataagggaaagaggaaggcaagagagactggatcaagtggagatcaatttgaagatgctttgctgctggctttgaagatgaaggaggaggccaggagtcaaggaaagcaggtggcttctggaagtcagaaaatgcaatgaaacgttctcccctacagcctcagagagagcccagccctgccaattcatttcagacctgtgacctctagaactggaagataatgaatttttgttgttttaagccactaagtgtgtggcaatttgttatgttaacaggaaaccaatacagataggaaaactaagtcctggcccctgatagacatgtaataagtatgtgtttagttaatgcacgaatgaggcttagagaggtacagtggacgttctaaagtaacaaggcttccaagttctcaaacttacatggaaagttgaaaaatcccccttacctgataatagtggttaactcaagatgtgggacttggggacaggaggagaagggagacttacttttcactacagcttattatactacctgaatttgtcaccctgtgcacatattgcctatttaagaaaagttaatgacccttgtcttcaagtctgagggataagacaggtgtatagatcaaaatagaaaagaaagtaatcagtaacccaatgccacatctgaaggtaggtactgtgacaattcaatatttttggatatgctcagttaattaaatctgaattccagtgcctatctgctcaagctaccatccacccactctctttcttttcctcttcaaaggtttcaactctaaaaatagtgtacatctatactgccctgtcccttcttagccccatgaaattttgcatgtactctgcccccagtaaaatgctaagctgctcatcctcatagggaaatgatatcaactcatgggcagggcatgacttttgtagacaagagctagatttgaaacctagtatccacatcagagtaaccaagaaaaatttatttaaaccttctgagcctcagtttttctatctgtgaaatggcatcatgatgtgttataaggatttgttggtttatttatttgtttttgaacagaattcagtcaagcaatgtatgtaaagcatttggcatggtatgtggcacccaatacatattagttcaatttccctctttatgtattttcttcccttttccgcagtagccaaagcttttatcttagcccttagcttctccaaactttctgcagtataggacaaaattgatctctctttcacccctctcactttcctctcccactttgtttttttcatcctgtaatttgtgcaatagaaattttacaaggaatacaaaaagtgcagacatcattccagcattgtgaaatgaagatggcttaatcagacagttgtgctcatgtgggatcccctgggccatttataggcaccatttaagttcagaactccacacacgctcagtatgtttcaggtgatatatatggttgttacatgtaaacctatgttaggcagttcctgccacaaagatgctatgtaacacaccagccccaaactcactgccttccaactccactttcattctcatgtacacaaatttataggctgactgtgttcatctgatctagaattggttccctggggtggctctgcttgaagctgcaggacaaaggggtgtggatccagcctcatcctgagaccaggctgaaagggcagcagccactgagggtatgttcttttcaggtgatggcagaaatgcagagggaaagcccaaccacacaaacacagtgcccagtaatggcccaataaagtcacaaggccaatgtcaagaggtgagacggtacattctgcccactgtaaggccgtagcaagggagtggctagacactaatactagggagagtgaagcattgggaacaattatctaacctactacactatcaatccacctgaagtgattagcaagtaatcccccattcttccccagctccccttccacaaatcctcaccaggaattcacataagccatgaagactatgactaatgttggtagttgggtttctaaatcaatagtcaagaaaaaaagcttcattaaacgtgtcattaaccccctgaaattgtaagtattcataagcacgtgggtacataccttttctattgagagagtacaaaactttagattctcaataagaatttcagaactacttctctcactagcctcatattcacagccaggagcggttctttagcacagcagcaagacacagctatagtattaagttctgaacctgggatagtcaatggcctgatccagtttgtgccacaatcatcctccccaagaacttcactcagagcatctcagcctaaacatcacctcgccacaccagcctcccctgatcacttgagttgatacagctcttctcatccccagttacttccctatcccatcgcccatgttatttcctaggtcttattgaatttatgtgttagttattattttctgtcccctcccactagaatgcaagctccatgtccttatccgtcttgtccccaatcttaacatagcgtctaacacatagtggaagccccatacgtatgttaaatttatgaaatgaatgaatggatgaatgaatatgagcatcattgggagatgctagataaagctaacaacctagcatggaattcatgggtctctagagaatacgctccccaaggtgtttgtgggaagttttgtaaaagagtgtgttaaaatgtacacacatggtggatgggctgggagagaactatgggagaaaattaacaatctgtgctttgttcttcacttgagttatgcgtgattagcttccaatgaaaaagacatttcttcacacacacacacgaattcatgtgtacacacacacacacacacacacacacacagacacaccccccagagtctcttatatgtgagtctatctcctagacttgtggttctcagccagaggcaattttgtcccccaggagacattggcaaagtctggaaacattttaaattgtcacaacttggggtgggagagctactggcatccgataggtagaggccaggaatgttgctaaatatcttgaaacacatcccactttatcacccactacaaagagttttccagcccaatatgtcaatagtaccaagattgaaaactcttgttctagaaccagaaatttacacatgtttacacacacatccatggcatggtaggatccaaagaccatcttggctagccaactctctaatctctgatcatggtgtccagataacaggacttaatctcattttgaaatctctgtctttttaaagttttgacaaatatttaccagaaaacctcttatgaagccaacactttcatatctattctctcatttagggagtattgcaaaatcccgttttactaatgtggaagctaagactcagggaagttaagtcatttgtcaaagttacgcagctagaaattgcagagtcagggttcaagcacctatttcactgaattgtgctcagatgtctttcttccggccaccagcacttcacttcatgttctttatgaatagttttgttttacattaattttctctgtctggagagccccaagctgacttgctgcatatcagtgctccaaagagccctcttgtttagtcaacttccctatgaaaagatacagtgagcaccacctaagaagcatagatacttgctgctgctgctgctgctgcagaagcttctatctctcagttcatctttattacttctttgtatttgcacttgtacactgctgcagaagcttctatctctcagttcatctttattccttctttttatttgtacttgcgcaatttgggcagttccaggccttttctctcaaccccaatgtctgccagtctggaaagtgtcatctgaagccctcctagattcaggagaagtttcctgggttgtcgtccatagaagaatccctcacacaaggtcaccaacaacccagcaccttcccaggggtgttctcttggttctacagcaagacagctccactgtagctatagtgacatccaaagattaatgccattaatgctcccagtgccactgtgtaaatttttaactctttcctgcctgcatgttcaagttacacagccaatacacagcacatgataagtgcacagttaatctttcagattaatcttgacaataagcaaacaaacaataaatgaataatatgtacatacataaaaataacccaaaagtgttgttattcttgtggtacttgtgttttaatgaagaactttttatttagtttatctattcgttcaacaaatagttactgagcttctttgaagctctaaaccctgtgctagatgctaaagaaaaaagtataaacaaagataggcaagaccctgtcctcagagagcttacattccagtggcaggtctggactttggtcatggcctttttaatgcataattatgaaacagaataagtgatctgaggaaacactgtgggggctctgagaatgcttatcaggagaatttcactggatctggccagggctgggcagagaaatctttcctaaggaaagatcctgaagggccctaaccttaaaggaagattctccaatgtgagagtgttcatcacctgcagcaattgataagcatggcattgggagtaggatatgccaccctcctggggtgtcacacattccacatgtgctaggtgacaccctttgccaagaagcagagctgggctgaacattcagtttcctaggagcagtagctgagtgcagtaatctttagactttccatttgcttatcccccaaaataacttctgaaagtttggtgcctcctagcaaaggatatcatttttaagatggcaaatattgaaattgttaaacaaaactgtcaaacactttttaaaatgtaatcaatagtaagcatagtaatttcatacccaccatcatccatttaaaaaatgaacacgctctcctgtaacagtcagatattttacatccctcacagacttttaagctcatgcaatatattttgatgcttgaaaatctttaattgttcatttttatggctgcatagtatttcatggtgcatatgtaccacaatttctttatccagtcagtcactgatgggaattgaggttgattccatgtctttgctattgtgaatcgtgctgcaatgagcatacgtatgcatgtgaagaggatcaggaaaaataactaatgggtatagacttaatacctaggtggtaaaataatctgtacaacaaatccttatgacacaagtttacctatataacaaacctgcacatgtactcttgaacttaaaattaaaatttaaaaaatctttaattgatcatacctatctgctacaacaatatgtaaataaattgacttttaaattttgtttgtaatacctaggactatgtggttcaagtattaaaaagaatttcctctatatgaatacaccattattattactaagacatgaattaaagcaagatatatacattataaattttgataaatatttattaagcagaaagaaatcaattgtattggaaattcctctattaatggggatgattatgacaaattacatgaaagaaagagtgttcagtatcgattctatttcttttttgtgtttatacacattaaatgcccagaaaatgtgttcacaaaatagctacatagaaatggaagcttcttttttaaacattgttattcaaatcattattgcaactgactatggaacaaaaacatcaaaaatattttttaatgttttgaattatccttttggtgtcctagaagttttttgtgatagtccaatgcagagtaatgagactctcaataagcaaagatatggtcttttgtgtttcttatgggaaatgggagattattaaataatgaggagaaattttagtgttcttaatcagttggccaagtttaaggaaagtttatatggaagttgataatccaaaaccaaatttcttcatatgtctctccgaaaatacttataaatcttcagggtatatataccccagtttgaagaccactggctttgagaatcctatcagtctttaatcacctctaaagactgacaatattcttggtttttgttcaacatgttgaccctccccaatgtgggcgagaggccatctcagtggatgttatgaacagcctcatcctccttcaaagtgaagggccccctactggatttttcacactatatgccagtgcagggtggattctcctgttgagaattaaacaccaggaagagaacagagaggatggaatgagaatgggtaggacaacttggtctgggaggtcaagaaacacttaactggaacagtgacatctgactgaggtacaaaagattaatagaagtcaactggaccaggagggaaagtaggagagggagaacatttcaggcagagagcatggcacatgggaaaggactgaagaagagaagagcatgagggttcttatatgctcagaggaagagagtacaacttattcttcatgcaatgggaagccgttgaattgttttaaaggaggaactaacatggtcggatctatacttctctacagtcactctggaaactgatgattaccaagcccctgaagcataagtccagaagaggaatgaacaagctagcctagagcaaaataggactgccaccgcctccatactagacagcagaatgcaacctatgatcattacttggctctttgcagccccttcgcagtgtaccccagacactgatgtctccttccatctccatgctgttgagtcacttctctcaaaccctgacagtgaacatttggcttgctagtcccagaataagactgcacagctcttcattctctctctttccaaaccaaattactgatctgttcctttgttaaattgctttggtgcctgatgatctatacatttaggtgtaatcttctcccccagcaacttctccagatctttttatttcctaaacagaatgctggtgcaagctgttaataaatattttcacaccattacacatgatatgatcttatgagttgatatggcacctatggtatatcttatagtataacataacacaacataatatatttgagagttagtcataataagtttattatgaatgatttatagccccaagtaaatatgtacatgattaataataattgttattatgaaatgcatatttgattacccaaagcctttttagatagtgcaaagttccaggttaaactgtttccttgctttataaaataagatgagaaaaataccaaattcataactatgaataaatattaagtgacaaaataatatattgtaggtaagtctgagatgccctgggttgtggtacgtggagagatgtaattctttttttgcctacaaaactttttagattccttattgtgtcaagcaagtctttttataaatttccatgatatgatatacaaggtttcccaaacacatttgaccacagagcacttgtacagagagcaccatgctgactggcattctgcagaacatgctgcagaaaacacagtagctggagaatgtctcaagctttcttcatttcttagtgccctgggattcttagatcctacttaaacctgttaccaaatcctatttcttggcaagaacattcctcatcccctcttctaccctcaagtcatcttctcttgccaccttcagtgcaaaataatttttttccaagtttcagtttggataatttgatctccttatggtcaagaatcatgtcttactcaactttgtatattatagttgccagtttatggtaagcacttagtaaatagttgttaaggaatgaatagtaaccagcatacagcatactttataaactgtgactcttttcacccttctcctaaaacagaatataagagattacataagtatgtatagtgtatttcagggactcattgtatggaacttactgcaaatattcactggtgcttgtggtcttcatggaccgtgaagccagtctttgcattttgtgaaccttagttgcgtggagcaatattataatacttccaccactctctggtttcttagaagttacactgctcttcaactgttttaccctcagtccaagttctaggtaaatgattcaggataatccttctctttttttgttttcagaagttcataaccaattagatgaggagattgagagttgaactggggaagtaaaaatgtaacttgaacatctgaagaaaaccactttagtttctaaatgcattgactttccttgagttacagtaaaaagtcagacaagccacatctcagaaagtgctgtgtgcacacatttgtacattagagccctccaccccaagaaagccatgcaaagcatgcaatacatttcccagaaaaggcagcatcatgaaacagatcctcctgggccactgctatgtgcttccttccagctctgtagctgggtgttggactttctcattttctgttctgctcagaaaggcgttttgttcttgaacaaaaaatacctgggcagggaatctctgtcataactgcttaatgcctggtcttgggggaagagatggagatcactgtcacttccccagtgtggtatccaggaaggacagcagctctggaaagccaagccatgccttcaaaggacctgtactcatctttggccatctttggccaattgtctgtagtcatactcacaggagattgtaagaggaaaaaaatacaaatacttccatgaggatatcaaggcttcttactgccgaaaggaggctgttgagaattgaaacttctcttcagatccactgaacctaggcttctttcccctctagctctatctgagaagcaatatgagaagcaatatacaggagcacatattttggtgaagcaagtcttccttctagtacagattccacccttttataggactggaatgcttcagatgcagtgaccagccctaagtttacaaaaatcacgctgctcttgcacagcttccagtctagtgagagagaaagggatgtgggagaatgtttatgatatattgtaatacggacatttccaagagagacattaatttgggttaacctcatctgtggtactcaggagagctagtcagagacaggaatgctttaagtagatgttaaagtaagagcaggtgttaacactaaggtgggctatattattctataggaatacaaattatctaaatctaaacggagaaacacaatcgaagtttatttccagcttatgcaaagtctaattcagatgttcatagtgagacagctctactgagtagctcttgttcacacagtgatttggtatcctcatccacatcaatttaggggttctgctattccttaggacctcagaattcttcttctggatcttcaacagattgtcttcatcttcacaatgaggaatgacacagaatatagatctctcaagagattttaagagtcaaccaagaattaccttacatcactgctatccacatcacagtagccagaaatagccatgtggctccactaaatggcaaaaggaagctaggaaaggtaatttttctgtattctcaaaggagtagggaagtgtgtttgattatagtattggttatgccacaataggatttgccaaggagcaagagaaaggtatttcatgggaaaggaatggggatctggctttgaaagtacatggtggcctgttcctcaatgggagcaccaggaagaacagagcctttcaagaaaaatatatttggaaatcagacaggaaaactcatggcagactaagatatttgtggaagagggttgcaaagagtaaagttggaaagttggtcttggggtcagctggggtataagctggactattccagtgagactagttctttcctaaatagtacacacttggtctccattccctgtaaaagggacaagtccccagagaagtttctacaaaggatgatttgacctatttaaaaacatgagctggtctttccattttttatttttatgtccagagagaccccgatgtcagagacctaaagatctgcgagtgaatccagggtttactcttcaatgcaggagctttcaccaccagccttagcctcatgcaaactgctcccttagtgtgcacctggaaggcttgaaatacacagtccgtgagtcaagagcataggtaatttccaagcaaatcctaaatgttgggttcagagaagggagcttttgagacctatagaggcatggtctaaaatgtagattggaggccttcacagagaactctttagaagaagatgcaggccatcacaattagacttgatgtctacaccctgtcttctcactcacctttgtaggctgagagatcaaatgtgttgactgattctaacttccatcctgtcatggtttatttttttaagtttaaataattatttactttaatttcttttgataatataaacatattacaaaaattatgtaatatggaaaagtagaaaaaaaacccaaaatcttactactcaaaaattgagcattgagcaaacatttttctagaacattctctatatttaagatggagggaaggaaggaaggaaggaagagtgagagaggataaggtattacaatgaaaccatgttttacatcctggcatagtacttttatgttttaacagaagcagtgatatttattaaaaattcaaaacacaaaaatgaagtttcagaaaaactgtcttcaactgatccctcatgttaataggaatgccttcacttaaaactcttcttaaactactcactggggctaccctgccagctaccattttttagtctttcttgattccttcattgaccaaatatttattgagggcctaccctgagccaagcaagcactaggctaatgcagcaattagagggagcaagactgatgcagttcccatcctcaggcaacttagatagagaagagtgtttctagaatcatggctcaataggccagagagtctggattcatcgttatagtgtgaggcccaagaacctgcattttcaacaggtctccaggtgacttagatgcacattgcaatttgagaaccactgtgctagcagagattttatgtcaaaaaagatggataattcattgccaagaaaaagcatggcaggtaaatgattgtctcaagtcaggaatccaggtcaggagtgagcaatggtccagtatgatggagctagactgatcattatgcacaatcccgtggtgtaattatgggtcttccctgattcatatgcggatctgagttatcactgaaatggtgaggacatttcctttacagaaagcagcatctttacaggtaagggactttggcggatgtttatagcaggatatgtcctttgggtaatctactagatccgttttcaagaattttgatgcaggaatgttaactccgacgtctatgaatatctgccagcagtgacttctgtgtgctctggcaaatgtcacgaggacttagactctttagcacaaagattcccagagaaagggactgtgaactgctgaggattagggtcaactcagctagaagctgagtccttgtcttgaaatatgtagctaaaataattgtttttctctctctgattggttgaaaggagatcaaaattaaatgtgcagaagaagttaagatctaatgcgtatcctgaaagcgtgctcaagaaaggtctaggtgagagagaactgtgctttcaacatttaaataacactgcttagcatgattacatgaagccaggtagaaatccacttacctatttatgcaattatgaaaacggaatgaatacgctgtttggaggatatataatattcagatggaaaccttcaggtttttctttttctttttttttttttttgagacggagtttcgctcttgttgcccagactggagtgcaatggcgcaatctcagctcaccgcaacctctgcttccctggttcaagcaatgctcctgcttcagcctcccaggtagctgggattacaggcatgcaccaccacacccagctaattttgtatttttagtagagatggggtttctccatgttggtcaggctggtctcgaacttgcgacctcaggtaatccgcctgtcttggcctcccaaactggtgggattacaggtgtgagccactgtgcccagcctaaccttcagattttaatcaccctctaaccctttaaagccctttaaagacatatctttaaagatatgtgtttctaatgactaattataagtattattttataaaattctgaagcggtagaggtctacataaacacctgttagataataatatttatcatttgaatgagtgagtgaatgaatgcttgagaaaataaaatttaaaaaccagaaatttgtaaaaaaaaaaataaaaggctctgaaacgctaattatcataaactcagtatttttttccatgctagcttataaactttgtttatatatatttttagcaatattcagatctcttttttttattgacatcagtttaggcacgagaaaagttttgtgtttctagactctgggaaaataaatatcgattgtcatgagcagatttaactgatagccttataatttaaaaatacgattttaaaaagacagattcaaaattctaaaatcacaaatgactggtggcatacagacaggccataataccccaagtacctttgaggacatcacacattgcaataattgacattcatactaatgacttcaggtgatcaagaaatgtttatgttaggcctgtatattctagttaaaagacttggaggtgtatagtacaattaaactttttctccataattagtttctgatattttatgggattggcttttattatgggtagaattcacttgggcagaaagcctctttccctagtgactaggcttgtcagatatagcaaataaaaatacaggatgcccagttaaatttgaatttcagcaaaacaactaatcaactaatcacttttcagtataaatatatcacatcctatatttggaacacacttatgccccatgcaatatttgggacacaattatactaaaaaaattgtctttgaaatttaaatttaactcagtgtcctgtatttcatttggaaaccctaccagtgactaaaaagcaacctatatctcagaattggtacattctggaatggttgcacttaagaaatctggctaattctatgagtcaactccacagagcttttcagaagaactctataaacttgagaataaaacagccttctaatgcaaactactgtctttcctctgaaagtctcaagtcaagtgagatgaaaacttgagacaaacctgcaggaggaatgcaaataaagattataagctctaggagagttgatttcaaggagcaaattaactcactaaggccccttgtgaaatcacctccactgaaatgagttctatggtgagggctaagacttttattgaagacaaagtatcatgacactcattattaaaatttccatgtaatgttattggagatcctgtagtctgtttctgtccctcagtcttgacctgcctggaagtcttgtctaactctcctctacctgattagctgcttctttctctgcaagtctccatcttagctctaattccatgattctgtaattgcctgtttatctgtagagttcttccactagattctttgaaggacagggatgtattttctgactttgtattcccagtggcagaacagtgcctggcatgcaatgaatacacaatagatgtttgaatggatagaagagagggagaaagaatggatggatggatggatggatggatggatggatggatggatgatatggttgaaaatattatgttgtacttatggagaggaaaaagttggctcttatgcttgtgtaagaatagtcgtagtcactttattcatatttgttacagcttaaaaaagccaacttatccacaatagaaaaatggataaacaaactggtatattaacccaatggaattctacctaatagtaaaaaggaacaaactactgatgtagtatgcacaacatggataaacttcaaaaataccgtgctgagcaatagaagacatgtaagagtacataatatatgactccttttttgtgaacatctaaacatagaaaactaacttggggtagaaaaacttaaaaacaaagtttttctgggaaatggaaggtgctgggaatttactgggaaggggcataagagaattttctgggtgatgacattgctctatattgatagtaatttagttggataagtgcatgcattcatcaaaagtcaataaatgcacacttgagattcatgtgtttcattgtaagcaaactttacctcttaagagaaaaaaaaatgtaaacgaatactgaactctgtctacatgctgtagtatttagaggtattgtaatgatgtctgcaatttgccttgaaatacattcaaaaaataaaatggattgatggctggacagagagatacactgacacaagataaagcaggtatagtcaaatgttaatagtagaatccaggtgatgagtatacaagtgttcactgtaaattcctctcaattttgctgtattagaaattttacatgacaaaatgctgaggtgaaaaggagcttctggttcacataactatgcgaaggctgcacactagaaaggactctgaggttccctgaggatatttaagacctttctcagggtgtgcaaattacgtctgaggctttctagagaaacaattcatctaacaccagacacccaaaaaccatttggccaaactaggtaaaaccagagagaattctactcagagtatttttcattaccccagccattccagcactttctctcttggaaacactcgccgttatttaaaagcgagagtaaagccccatctccaggactccagctccttctcttgcacccattggcctctgtttgttagtgtctgactgagggaggccatgtcagagtcgataacaggtcgatgggagatgactgactccgagggttcgtgccaggctcagctgctctcttctgcagaagtgtgtgcctgaagatcactctccctgacacaatcctgcagctgctgaaggagaggatttactcggatgaaattcaggcccaaggggaactcgagcatcatgcccacaattagaagtgacatgtgacccaggagcggaattctggctgccagagaaaggagtgagctgattcttttgagttgttctgacttaagaaaactgcctttctaattcctctgcagagggcccagaaagttttctgtttgatcagttaaaatacaaaataataataatattgaaggtaataaatcccttttaagaatgaaaaatgtcacaggcatcttagggaagacagagggctgaagagttcaaccacgtactactggaaatgtctgggccttatggtgttctattcagagaagatttagattctgtccgccaacacacaggggagtagtgcactcctcatcgctgaaggtaagcaaatagacggtggatgagaataggagaggtccctaaagacgattaaagaatacagtggtgtatggactgaattgtatcccccctaaaattcatgtgctgaagttctgatcccccagtatcagaatataaccatatacgaagataaggtctttaaagaagtgatttcgttaaaatgagaatcttaggttggagccctagtccaatacgcctgatgtctttataagaagagaaacagacactaggagtgagcatgcacagagggctgaccatgagaagaagcagcgagggagccgccatctgcaagccaatgaaagaagcctcgaagcaaaccaaccctgcctctggaactatgaggaagtaaattatttaagccatccaatctgtggtattttgttagagcagccttagcaaattaatgcactctctgaaaacttctgggcagtgcattatccatctttttgacaatgaagctctactagcccagtggttctcaaactgcattgtgcatccaaatcatctgaacaacttttgaaatgcaggttcctgaacttcacactataaccatgagaacagtcttcctggcatattgaacaatgctttcaggaacattcttttgcactcaagttcagtgagaatgaggactgtcagtcttgctccctttgattccctgcactagcctagtgcttggcctaggctgggccttcgataactatgcacaagtggggcttgaagtagatggttttccaaattccatctctgaaggtaagctgcatgggggaaagctcttcaatttgttcataacatagaggatttctctgtattattccagacagatattctagtccttgacagatggtaggcatttaataagtaattgttgaatgagtgaatcttataagatgttctagagaactctgcgttagtgaaattgcagtgccaagaacagaatcttttaaacttctatgttggctcttgatatagttttattatatctattatttcatctaattattttatggtttgattttagatatttggaaaatacaggcatttagggagaacattaaagtctcctgaaatcccaaccctaaaatataactatggtgaatattttggttcattttcttcattcataaaaatatgtatttagataagttcaaaagaaattgcaaatacaataatttatcttttttccaaagattatattttcccattttgctacatattttctgaaataggatctttaacaaatgaataatattccatcatgaggatgtcatatttaatcacctaaaatttgacttaaatataatagaaaagaagaaaatgaatgtgcatgtccaaaaaaacattaattttggaagttgcatttagggaggtgaaatttgtttccatgttttattaggttggtgcaaaagtaattgtgatttttaccaccactttcactggcaaaaacctcaattacttttacaccaacctgtaattggctatttggatatctcctccttttcataattttttgattgttttatgcttagaaaatctttttccacattcaaatcagttaattaataacttccactttctttagaggtatttccattaccgaaataatacatgctcatgatgcaagttttgaaagtatatgaaacctaaaagaacttagaaagttgtctctaatattttgaacttctgttgtattccttcccatcaattttcagtgcatatttttatatatttgttataatatagtacctataaaattgtatatactaattttaagtttatttgtatgattataaaatgaacatctgatcactgtataaaatctggaaactacacagtaccatgtggagaaaataaaaacaactaaaacccaattccccaggcagaatcactgttacatttggtatacaatacttacttccagtttttttggttaaatgtatttttacataattgcagatgtgcaatatgcacaaaattacactgattttaatcatttattattttgcatctagaatttatactcatgatagaaaattacacatataaaaacaaaatgaaaaattaaaatcactaatagtagtaattccaaacaatatattttaataactttgtatattacctcatagagtagtattcatgtcttccttgaaaggtagtcagagaatatacatctaatattatgcatatatgtatatacatatatatcacataatacatatgacacaatacttgtattcacaagttgtctatgtaaggtaatacaaacagaagactaatgactgatgtgtactctttaagtcattcaatgttttttcctttcttctatattttgaaagtctctcaaccttgcccttcaagttaccaccttgatttaatgcagagacattctaccctgtactccctccaatgatgattttaattatctcctgaaaattagcttccttatgtcaacctggtcttcgccagtttttttcctccatctattattgtcttacggctttctgtttaccattcagaatttgtactctttttttgggttttagtttgtaaattttttttctacattttttttgttttttctgattaaacttttttttatataattgtagatcacatgcagttttaagaaacaatacagagaaattgtggtaacctttacccagttttccccagaattttaatgttaacatcatgcaaaatcatagtacaattttcacaaccaggttattgacattgatacagtcaagatacagactagttctatatacttcttgttgttcttttgatactcaggctcacctctgtccccctcctttggcctccccttgtacctgatccctggaaaccattaatctgttctgtgtttctataatgttatcatcataggaatgttttatatatggaataatacattacacaccttttgaaattttttttcattcagcgtaatatcttagaaattcaaataagttactggttttatttttatgttttgagacatttatataaatgatacatgtaattgtgagggacaaactttaaagtgatttccatgatcaagactttctagtatttatacatttgtgtaatcctttccccttgagtgtgagcaggacctctaattttcttctgatccatgcaatgaagcaaatgccatgtatgtgatttgttcatgtgtttttgttaagcatgtatcatcatcttgctagagtctctttctcccttgctgatttttaagaagcaatatgccatgaaggaaggagtcatattagaaaatttcatgtagcaaggaattttgagtggtctctaagggctgcagaacatttcttgaaagaaactagacctttcatttgtgcagccataagaacataattatcccaacagactgagggatatttgaagtaattccttccccagtggtgcctctgatgagaccacaaccctggctgtcacctggaatgcagcttggtaagatgctgaagtacagagtccagttaagccatgccaagatttctgacctacagaaactgtgatataataaatgtgtgttattttaagtcgccaagtttttggtaaaaccaatacagtaatctactgcaacttcctttttccactcgatgtcatacttttgagatttgatatattatttaattgttttacagaatttcagtgtctatacaaaccacaactcctctattctaccactaataaagggtgtgtttctgcttcttagacattagaaagcaagtgttttagagaatatccttatacttactcaggacatatacaatagtttctctacaaaatatatctcaaaatgaaattacaagtatatgtgcatgttcaacattactgtaatattgccaatttgctctcaaaagtggttgcatagattttgtacaggacaattcctggttccccacgttgtgaccaacacttggtatgatcaaactaagtaattttgctactgtaatccatgtgaaatgacagctttttgttccctagtattgattactgatgaaactgagcatttcatatgttaaatggtcacttgggtttcaagttaccgattcatgccctttgcccatttttctattgatgatcttttatttttgttattgattcataaggggctcttttatactctggattcttatcctttattgattataaattgccaaaaagctcttccaatttataaatgacatttcatttaacctatggtaatttgtctattttttcaaaatttcaaagtccagtacatccatctttttctctatagtttgcatattttatgcccggtttaagaaatgtttcctcccccaaagccataaagatattcttctacattgcttctaaatcatttcaagtttgctttcatgcttgggtctctaagcacttagaatttatacttttagggtgaagtcagaatttacttttacttttcctcatggttaagcaattgtcccagcttcataaattgagtagctcattttttattgacataaatgttgcttctgtcaaacaccagtttgtctttatacatgtggatctattttgaggtcatttattggttacatttatgtaatatgtctatctgtgagacaaaaccacattattttaattactaaaattttaataagtcttgaaatgtggtaaggttgattccagtgattatctttcttaaaattgaactttattattttttaatctttactttcatataaattttagggtcagtttgtcaagctcaataaaagaaacaaattaaaaaccctgttgggattgggattttcattgaaattacatttaacctatgaattaatttgtggaaaattgccagtactatgatactgattcttcctaacttatgcatgggaattgtatcacgatcctccaaagatatccacttcctatgaatatgttaggctacctgaaaaagggaaattaaggttgcagatgaaattaagtttgctggtcaggttaccttgagatgggaagattatcttgcattatctgtgagcccaatataatcataagtgttcttaaaggtggagaacagtcagtgtcagcgtgaagcaatgtgagaactgctcgatcagctgttgctggctttgaaaatatagagggtacatgaaccaagaaatgtaggcatcctctagaagccatgaacctagaaattcaggtggcctctagaagctagaaaaggcaagaatatggattctcccctagagcctctagaaagaaatgtagcccttctgataccttgattttagcccagtaagacccattttggacttctgacctcaagaatcttaagataataaattatgttgtttttagacactaagtttgtaataatttgttaaaccaatacacagagataggtaggtaggtaggtaggtagatagattagacagagagagagaaagagagagggaggcaataggaaactaactcaggtcagtgtgcgtggatgggtgtttgtgtgggcccgagcatgtgcatgtgtgtacttaaatttatggtagaagtttcttatatgtttgcattttgattagagattgttctctttataatatgacttatttactttattcaagactagctttgagtccaagtatactgtcatttcttttaaatgtcccacccttgcttaaaaagaaaatatatttcctgactttctcagagttatttgtcaagttctatatatgttcaataggaccacacttgctatctacactgttcaattttttatctcttctgacatttgaattactgagagagaagtattatattttccatattaattgtgaattttgcaatttttccttgcaatttcattcattttggggagtcatgtgcatataagttttaaataccattattttctacctttatctttatgtcattactctatttattcataaaatgcattttgtcttgaaatctacttttctgtattaatatattcacactatttttatttgtcttcactttcaagttttctatatcatattttaggtgtttttcttataaacaacaattggctggattttgtaatttttaattcaatttgtgagcctctgttctaacaagcttatctgctatatttattgtgttgactcatatatccatttatttctatcattttattttgttccatttactatgttttttctttgcttccctcttttccccttcttcctacctcccactgggtttttttcacccctttctccatgtcttcctagcctctgattgttttggaaaagtaatgttcttttattaattctgaatggatacttcaaatatttaatatgaacaagtggcttaggaaggataaagtgattaatatctcaatgcttgttcaaaacaatttaagaacttggaatcctccagctccaaatgtcccattctattttacctgctatttgtagaactcaatgcagtcattgttatttttatttcatactatcaatgcttctatagatctagttataagttaactaacataggctgggcaaggtggctcatgcctgtaatcccagcactttaggagggcgaggcacgtggatcacttgagcccaggagttcaagaccaacttgggcaatacggtgaaaccctgtctctacaaaaaatacaaaacttagctgggcatgaatgcacactcctgtggtctttaaaaattttacttgggaggctgaggtgagaggatcacttgagccctggaggcagaggttgcagtgagccaagatggtgtcactgcactccagcctgggtgacagagtgagaccctgtctcaataaaaaataaattaactaaaaataaataaagaaagaagtttcctaatgtcaatgattatcagtgcttcttctgctcctctctgtccttatgaattcgattcttatttttcctgaaatgtaatctttagtatctcttccagggaacatctgtaagtggtaagttcacttagtctttgtttctatgacaatatctatagttcaccatcatactgaaatgatacttcagctggatataagattctgggataatggcaaattttctctcatcccattgagggtattataagacagtattttggaatttctgattgctgttaagaagtttgctgtcagtacaattctttcctttataaacaacctgcttatcccaagttgttttaaatagctttcttttatctttgaggtactcacatatatctccaagttacctaattttcttttgttttttttttttcatatatgttcttcattatgtcaattgaggggataatttcaaaccatgtatttttatctttaaaaattttatttgattctatttcagtttaatctattcattcactcagtgccttgatcttaatagtgtatttattcctatactacctatgcttttagttatcttatacatgcatattttgcatttctgtcactctattatttgattatctcaatttgtgcctctctaatattatttgttatatatgcatttttataatttttgatactgtagctatctttagatagattttcatcacagtaatcctgccatttgattttagggaggtactttctattatgcttctgtactgtagaataggggtatatcatcatttaaaccaatttttatagatttttttaacttagtggatctagacacaaaactctgtgaaaagcacatctttatagactttatttttcatgagaaacttttcattttatctttaatccttttgttttagttttcttgttatttattcagtttattcagtaatatgagtgtattctttttatgcagatacaacttacagagtacgcaaatcttaagtgtatgattcaatgaattcttacatatgtatgcacgtaactaccacacaaatcaagtcgaacttttcagcactccagagggttcccctgtgctttcacccgattggtctatgatttggagtatatctttcagatttccaaagatagccaatatgctgacttacagcatcattcaacggtttcatctgtctttaaattttctataaataaaatcacactgtaaacacctttttggatttttttttttttttttttttgagactgtctcactctgttgcccaggctcactgcaacctccgcctcccagattcaagcaattctcccgcctcagcctcccgagtagctgggactctaggcatgcgccaccatacccagctaatttttctgtatttttagtagagacagggtttcaccatgttggccaggatggtctcgatctcttgacctcgtgatccacccacctcagcctcccaaagtgttgggattacaggcgtgagccacggtgccctgccttgcattttcttttattcaaaattatgtctgagagattaatccatgttgttgcgttcattacggtctttgctacctggtattccattgtgtgtatataccacaatgcatccaacccattctactcttaactggacatttgagttatttctaggctttgtctcttatgaacaaagctactatgagaatttttgtgtatccttttgtgtggtaggatgtgaacttattctaattgtaaaaattcctaaagagcaaaagtcccatttgacagctgttttccctccttccttttcctagagataagcactgtttccaatttagtgtgtatctttccaaatcaccatttttaaaaattctagacatgtataagattttattgtattttaacataacagccatcatgtgaaatatatcattgtaaaccttattgtctttgccatttaaaatatgtattaaagaactttctatgtttgtatacagagtgctcattcattgtttttatttgctacattgtattccattctataattgttaagtagaattatcattttattcaaatatggagtttgtccctcaaaatagatttaacagtatctcataagctttaaaacatggtattcttttttattttgtaaatagtttttacttcaattttatgactgtgcattgaaatttctgcagcatatggttgtttttccttatttaagttcccaattattttggagggaggttggatgggaagatatgtttaaattcaaacgattaattttaatttttagtgcattataatccaaaaaatagcctataaaatttcttctgtgaggaatttagaggcatgtattttgatataatatagaataattattgtatttgaaaagaggtattctatgtgagatattaaaaattctatatggagagagttaaatatacatatttacatgtgccatatcatgacaatcattactgcccttctttatttttgcttacatggtctgttttttgctaatgtctacttatatgggttctggatatgtattatgttaccaagttctttatcattataaaatgatttcttttcttgttcactgcattttgacttggaccttaatttgtctgaaattaatctgtcattccttttttgctgttctttcatattttcctcctcaattgtttcatgtcctattttttttctctctctctctccctttttttttgtaattttgtttcaggttattttcttcaaagaaacatataaatgaagattatttttgatacaaccaagagacttgattttctacaaagtggtatttcaaatatttacatttattgttgtatcaaaatgttaatcatatttctgtgtcctattttatttctgatagcttcctcttttttcgcttttttaaaattatggaagctgtactttgtttatctttatctaatcaggtaattgtgaaggtatttttgccactttcattgatcaaaatgttgtctttcattaatatttatccaaaaaccttatttaaaatacaacttatcatataattaaagttggttttgccagttactttgtgataacctctgtgaatggactaatcatataaacctatcatccaaacagggacatttgacagagaaaggaggcattaggaatgaatagttactatatgtataaaacaagagaactgtagcatgttctcatgtctcttttagttataccaaacttttatttagataatctaagtaatgtctcagattattgtcacaacattattttcatacgttcatagacagtttaaatgattttatatgtatgttcagttctatcttatatgtaagtctttgcccaataagaaaattattccttctttctgtaataaatctcagtagtacatttcttttttttttttttttttttttttgagatggagtctcgctctgtcgcccaagctggagtgcagtggcgggatctcggctcactgcaagctccgcctcccgggttcacgccattctgcctcagcctcccaagtagctgggactacaggcgcccgccactacgcccggctaattttttgtatttttagtagagatggggtttcaccgttttagccgggatggtctcgatctcctgacctcgtgatcctcccgcctcggcctcccaaagtgctgggattacaggcgtgagccaccacgcccggccgtagtacatttcttattatttcttttgccaaatacatcaaacattaggaaattggatctttgttctcttaccaccataactattttcttttaccccattcagtggccaaaaaactttttctctaaataaccagagagtaaatagtttaggctttgtggatcatataggatctgttacaaccattaagtttgccagtgtagcatgaattagccacaggtgatacttaaagcaaccactgtgatggtgttccaataagattttatttataaaaacaggtgggagtcagatttatcctgagggctgtaattgctgacctctgagccaatttgtcaacttgtctttttcttcatatgtttagttattcttagagagatctttttcatatttttttgcacgctgattatagttttactgcctcctatgataattttgactataagatgaattttttttcataaacattcttagcatttttttaaatcaactcctttttgtctttcttcctgcttttttttttttttggtctcggcatagtttaccttttaatgctctccacttttatttaacagaatcaatatttctttatattctatgaaagaaaccccaaaatttcctatggtctatgatttcccaaaattttaaacacatttacatatatatatttgtttgcttgattgtcattctagtttattatcactgaagaagtaaaaaaaaaaaaaagaaaacatttcacaatcccattttgtaacagtcagaactacaactcagctcttgacctgcccaaaatctccctggttgtgaaaagatcaaattcttagttctatagcagaacagctttagcccagttctaaatgcctaacaagcaccaaaaccatatggctcttctggattatgtgtgattttttcctgccctccactgcctgattcttcagtactctggaccaatggaaccaatggaaaaatagtaagactgccagcatgggcctccaccctgagtctccttccctgtgtggctatttacacagttacatcctaaattcctccaccaacaattagttgttgagagccttccaggagccaagcatttccctgagtgctaaggattcattggctaaggatattacatatcaagccaatgtgttagttacaaatgaactaatttcgaggaggtgatcttgaagaaaagaccaatgatatagctgctgagatgagatttaaatgattagaaggagccaccatgtgaaaatctggcgaaagaactgaccaactgcagggaacaaaaagtgcaaatgtcctaaagaggacatttatatatattatatattccaggatcagaaaggccagtgtggctgcagtatggaggatggtgggagacaaagccaaataaataagaaggaatcagctgggtgcagtgggtcatgcctgtaatcgcagctctttgggaggccaaggcgggcagataacctgaggtcaggagtccaagaccagcctggccaacatagtgaaaccccgtctgtactaaaaatacaaaaaaaaaaaaaaaaaaaaattagccaggcatggtggcaggcgcatgtagttccagctactcaggaggctgaggcaggagaatcactttaacctgggaggcagaggttgcagtgagccgagatagagccattgcactccagcctgagtgacaatattgaaactccatctcaagaaaaaaaaaaaaaaaagaaggaatcagatgacaatagactttgtaagccatggtcaggaatttggcttatgtcagaagtacaacaggagcactgggagggttttaacatggaaagatccatgatctgatttatagttttgaaagatcaagagaccaacatgaaggctattgtagtaatctaagtaaaagataattgtgatatggtttgcagtgtagtagtagtgaagaaagagagaaataaatggatttgagtttttagcctaatgacagtgccaatagattcatatgaaagttgaagaaaatcaaggaaccaagaacattgactatatttgggcttaagtaactgagaggagggatttattgctatttactgaggtggaaaaacttggaatcaagcaggagatggtaaaatcaagatttttacccttgtctattagacatctaagcgaaggcagtctcccagtttccaaagttgaactccgaggctatttcctctgtgtatttccagtgtcttttagaagttgttgaatccaaattgatgtaattggtagtactactgaatacctgtgtgtgaccaccttaaagagtcatgtaacatgtaacacaggagtcaaggagaaggtcaaggccaaggtttctactttatttcagtcatgagattttctgtgttgttaagcaggtaaaggtgggctgcctgctagttatgattctcaaggtggtgtcatggttccatagttaactaaatcttctcccggattttggcaatagattcattggcgcagcagatttttgtcaatgcctggctcatattctcttgatactcaatgttactcataccacaaacaattgaaattcaatttttgcctaaggacttttctggctgcagaagcaggcttgatctgtacatggagaaagccagaagtgctttccctgtttatttgctggacaaagaccccatcttcctgacctaggatggtacaattctatggtgtgttctacaccatcttccagaggttcccagaaataaaccccagcttcccatggaggtaacctattcattcatacaccttgtattggctttcttcccttctctctcattttcctacttttcctattagtacttcctagatttaattcccaaataaactacttgcacctagtctcagagtcaactcttggggtacccaaagtaagacagctattatctttattattgttttctggttatatgttttgaggtattctttgatttcatcaatattttaattaatagcatttggcctgatttaaaaaaaaaacatatcctagaatattttcaaaatacagaaaaagccaaaaataaaaaataaaaatcaccttgtaagccacagttaacattttgatatttgtggtatattttttctccagtctttctgctctctcttgtccttctttttcctattttcaagacaagtgaaaagagactatgtcagaaacaattccttaaatgccatttattccagacacagccctttgatatttgacataaggccgttttgtgtgtgcacaagctttactacagataccgttgtgtaaattcatgaatctggagaatccagtgagtactatgctcaatgaattgttttacatagcataatcactgactactccccaactcacttttaaaaacagagatcagaagttttgcctccattttatagatggtaaaacagacaaggcatggctttcatacatggaaggcatttcaaaggtcatttccttcactccttgaccgtattggctcatttctgctttgctttttgaaaagtcaatcttcttcgtgaccatgcagaattatctgacaagttaatgttgcctagctggcaacttgaaattgagtcattttaaaatctgcattgtaataatgggagtccctcatttctgagcctataactaattcaaaagcaattgaaatctcccaaggagatcacattgtagtgggaaacaatcccccagagtgagaccatgagacaggctaagtccatcaagcaggtatgcaggcaggcaagcagactccaggaagagggagaacccaaaatagaatggggatgtacagttgatcatcccatagtcaggctacttgattgactcccttaaaagtacatgttctcacaaagcaagctaatcctgatgcattgcaccaactgtaaacagagctcatatatttgtgcataagtctgttaatcaacaaacattattagataccatgtaagtgcagagtgctatgccctggagaacacaagggaacaaaactgcactctatcattgtgaacagctcacactggtttctttaaacatttactgagtgacttcaactgtgtttgtgtcagtgttaagcatgtttctgctaacaatcttgagatttggtgaagtacaaatataaaataattattacaactaagtaagtgtcattaataagatgtatggaaaggaatgagaaaaatttgctctatcaaagtaaatgtgtgtgacaacttagagaaaagtgaagtactatttgaatgagataatttttaaaagctatgaaaggtggtgaaatgtcaattgatttggggattcagaccatctccatgctggcttactgctccaaagaaaggaaaggcagccttcaatgctcagctctgagttttaatctagacttataagtccacagaaaatagtcttgagagcaaggctttcaagggagagaaaaggatcttctcagacctccttaaactccatgtttccatttaggaagtgaagcttagaaaaactaatcatagaccaggacagatgtggatatgtgggaaggaaatgtctccacacaggaagggttaaaccatcccttgctggaggatgcaaaagaaagtagagcaaagggttaaagactagcacctccctctccagttctagtgggatagagttgccccccaccccgcaagtgggcaggagttaaacatcgagatgagtataccagctgtcattctcccagtgccacaaggatgcataaactctccactgcatccatatgctatccaagcaaggaagtgaggtaggaggggtaaaacactggatgtaaggagaaaaaaaaggttgtctgagtcattaaccagagagagaggaagagagagagagagagagagagagagagagagagagattagggtttaaacagactatgtaattttaatatctttagatgacaagattgagcgcttttcaccaaaagaggtcctgcgaattagaagcaagagatagaaaataaagatagttgcattcacttaatgaaatgagttacttaaaaaccaccttaagatattagagaagttggtaaaatagggagctctttgatggcattatggagagggaaccttaaagtatttggatacttaacctgacaaaacgtatcttcctttaggttcactgatgagcaggagtgcttggaaccatagcagtacataggaaacacactttatgctgaggctttgcttcaaactacaaaatggagaactacattagcctgtgctgaatcagatagataaaactattagagatgattagctccaattggtttcacacctaaatatgtcactgggataccaaaaaaaaagtgatgaatacactttagaatgttcgagagaatgttcatcagtccctagtgcctagtgctgagttagggcagggtggatagaggcagtgatcctctctggctaccaggtaagaggcagaggaagagaagtctttgagggtgagaacaccaagcttcttctcatataaagatatcagatgggtcctatcaaaaactcctaatgtagataagagtgagaaagctgtgcccactttctctacctcatttcatgcatgatgattccatgcaccatggtttccaaagataaccccaacaattcatcctgtgtggttactatatgaatgtaaggttcctcctatcaagaggtgaagtctatttcccctacccttgagtaagggtggctttgtgatagctttgactaatagagtgatggtggaagtgatattgtacgtgatcccagcccaagtttcaatgggccttgtgttttctggctttgtgatttgggaccaccaccatgagaccaccacatagaccatcaggctagcctaccagagttaagagtccacatggaggtaaaccaaggcatactagatgacagttgacaccaactgccagacttaagaatgttctttttttcttttagatggagtttcactctttttgcccaggcttgagtgcaatggcacgatctcagctcactgcaacctccaactcccaggttcaagcaattctcttgcctcagtctcccgagtagctgagattataggcgcctgccaacatgtcaggctaattgtgtatttttagtagagatggggtttcaccatgttagccaagatgatcttgaactcctgacctccagtaatccacctgccttggactcccaaaatgctgggattacaggtgtgagccactgcgcccggccagaatgttccatcttgtatgtcccagcccagctgaccctccagccaaagcagccacttgtgtgagcctagttgaagccagcagaggaactgaccagccaacccacagaatcataacaaaaataaattgtggttgttttaagtcacgaagttttaaggtgatttgttatgcaggaatagataaataaagcaactaacaaacatgatgtgtttcttgtttctgacccatgtgattagcatcttggattccagggaatgatagcgggggcaccaatagaagtgcggggatggatggggtaagatcaagcagggagagtttcaagattccattgaaaccacccaggatcaactgggtttggcattacagcaatagctccatttttcctttccactttgcttgttggagagtgcagagaaagaaacactagcctgggagtcaggacctgtgtgttctaattattcaccttgacctttagatgacttaagccacccatgcctcaaaatgctcaactgccctgcctatctcacaccaagggctattgtatggacttaaagagaaaaacaactttggaagctctgaagcttgttgcaaacatgagacattgctataaattagatccaatgctattaattagatccattgctatttattgaaaccacaacctcctcaaattattagatgggataaaaggaaacattttatggctggaagtcatcagtactatcatcttgcaaatacagacctttatagaaaaggtgtgtccagccttggaacccagagcagaaagagcaagttgtcccagaaggatccctaagccacagaaaggaagaaaatctataaaaacatgaatcacctgagccttctgtcctcattttcagatctacaaaactggaaaatgtacaacagtatttacagagctctccatgtgctctggggatggaaaatgaatagaactagccataactcatcacctgtcatgtgccggatactctgtgaagatgtcttctatgtgtaatcttcattattcccttcaactgtcctataggattacagaaaattgatattcaagaagataagctatactataaggttcaaaggaggaaggtgatgggattggaaaagtttctatggatgacagagaatatgaggtggtttcaaaggataggtaaaattttaaatggaaaaaataggaaaaactcatactgtaaaataagcaagtatgaggtaaaaaatgataaaacaggatgctcgtggggcaccatttggctggagcagagccgtgtatgtagagagtagcgggagatgagattagaatgtggggctgagactctatcagcaaggattcaaccaaagagtagaaccagtaggaaatatatggacttgctacatggaagcaactttacacaattgcggaagctggttaagcagtctctgtaaagctgttgttctttgcatctgatgctggagctcaaatcctccatggcaggcagtcaggaagggaagaagaagagtgggctagaactcttagaactcaacaataaaagaacaaataacacaattttaaatgggtaaattatctaagtagacatctctccaaagaggataaataaataatcaataagcacatgaaaagatgttcaccaccaatagccattaggtgatgcaaatcaaaaccacaatgagatacccctccatacccactgggatgtcaataatcaaaaacgcagataacaaccagtattggaaaggttgtagacccattagaatcctactgccttgcttagcaggcaatagaacagtcaattagaaaaacatttggcagttgctcaaaataagttctcatatgacccagcaattccactcctaggtatatacccaagagaaatgaaaacacatttccacacaaaaacttgtacacagatgttcatagtactgttattcataatagccaaaaagtagaaaccatacaaatgaaagagtaaacaaaatgtggtatattcatataatggggtattattcaacaataaaagggtatcaagtactgatgatacatgctacaacagggataaactttgaaaaaaatgctaagacaaagaagccagatagcaaaggctacatattgtatgattccattcatataaaatgttcagaataaacaaatccatagaagaaacagaaaatagattggtagctgcctaggattggggttgggcaaggggtgggagagggggtagaaatatggagtgactgttaatgggtatgaagtttcctttcggggtgatgaaatgtactaaatttgtttgtggtaatagttgcacaactctgaatatattaaaggcaaataaactatacattttacatgtgcaaaatgtatagtatgtggattatatcaaaatactggtgttttttaattaaaaataagagcagaaatgaactggaaccccatgaggatgggctaaaatccttgtccatttttgttgcttctgaccttggtgatgaaggagtcctgcagaaatgggatctctttatcagggagctaagtgcacatgcaggtctaggagccagagaagctaaagagggatccaggggcaagtaaagcaattcatgcccaaatgcttcttaatgccaacgaggtgaatcagcacattcccaaccatgcatgctgcaaaatggctgccactttccttctgccctcccagtctcacaagaactttccttgtggctcaccctaactggaaacgtaaaaaagaggaccctaggaaatgtagtccagcctagccaagttgacacattgcaaagccattacagactctattgctgggagctttgaaggcaggaggagacattcttcagtgggaatctacaaagtgttaaaaatagggaagtaaaatattctaacctgagctttggcaaaataatctggcagcaagagggaaaatagtatgtagagacaggaagatcagctaaggatctgttgcataagtgagagttagtgaaagtctgaaaggagggacatgggaaggtaggaggagagagagagacagaaagaaggtggattagttctacttcttagtgtcatatgggcgctgtgttaacatattggaaataagggattaggtaaagaaagaaaagagacataactgaatttttaaagctccaaggctgagaagatggagttaccattaacagagacagcaatccaggaaaagaagcagattcgggcaaaagaaatgatgaactggccaggcctgtaatcccagcactttgggaggccaaggcaggcggatcacgaggccaggagatcgagaccatcctggctagcacagtgaaaccccatctctactaaaaatacaaaaaattagccggtcgtggtggcaggcgcctgtagtcccagctacttgggaagctgagacaggagaatggcgtgaacccgggagacggagcttgcagggagccaagatcgcaccactgcactccagcctgggcaacagagcaagactccatctcaaaaaaagaaagaaagaaagaaagaaatgatgaactttcaggtgtgatagtgtgacctatctggaagtcaaaaacttaggagtaaaatcagaggtttgagatacagtctctgaatcagtctctgtagtggtcatgggccaatggttcagatcaacaagagggaaaggatgtagagagagtggagaagggtcattgaaagcctgagggaagcactcagagaaacagcaggataatcaggaatgttagacttcccagaaatcagatggtaatgtttcaggaagaaatacgtaattacttccaaaactcaagtcaggactaggtatacactgtggtcacaacaccaactagattgggaccaacaaatgctgtagaatgagaggtggaattttttatcaagatttccattaaagagttgagctttcagatccataaatacagtggtagataaggtgagcaagctagggcatgcagtagtccaaaagcagaggaaaatatgttctaagaggtgattttgttgatgttattcatcagccatgctttccctgtctaaggcttttgaaggtcacttagtgacagatccagagccagtttttgacaacaatgatgacagcaactttgaagatgtttgacagaaaacaaaagtggggagaaggacagtgtgttgagtcttaaagcactgaaagatggtcttgttggatggaggaagtttggacatattggcaggaattagaatggatggaactgaacacaaagcgaggatgatgtagtctcattctggagaaacatcgtggactcattggaaaagtgatgaaattacaaaggtgtgaaaccctggaaaagtgtcaggtatgtgggattcctgcatgcactacattcgtcatgacggcaaaactcacccactggccaggagagcttgaaatcatttcctcaagggaaggccacattgctgaggaaatcatccctccctggaaatttctgatcctgattcccctcatttctctagaaatgatatcttaattgatttttaatcattttcatttctcaaagttaattaccctctgaaggtgcctacctatgtgtgtgtatgtgtgcatgtgtgtatgtgtgcgggtgttggtgtgcatgtatacacacaactgtgatcatctgattgtccttcttcatgaaaaataatattgttacaatcttgatactacatgtaaatacagttgataacaagcctttcaatacagaaaaaaacaaaggcaaacaaacaaacaaaaaaatcctgggaagtgtcttcacgttaatgtctaggttataatttctcacattttttcagtttcttacacacttagtgtctcagtaatattctcctggcaagtgtaggccaaaaggaaaacctgatccttttattagggagttaggtccaaaacactcagtatttatgtcttaacttaacagctattgaaaagagtaactcacatacattcaaataaattctccaatcacctggtctccaatcagcctcatctttgtttcccacacttctctacctgaaacatcctcccagctctgtctctacccacagctcctgtcctcatcacacagctcaagaatccccctgcctgtcatggcctccctccactctccaagagaattgctcacgccttcctctgtgcttccagaggactctgcccctgtccttaacatgcagcatcacagttattcactagtgagagactgcataccttcaagtgagggaacatgtttaattcatggctctttcctcagctcctaatggggtctgccaccttctaggtgcttactccatgtttattcattgaatgaatgatcgacgtcaccaaactcaccaagcaactttgaagtgaaaatgtaagagaactgtaggtgccagcctacatataaatgcacagccacatatacatatgcaagtctacatatacgcatgcatttatatgcatgctaacataaacatctgcctacatcccagtcgcctgaatagtagttctggatcctctccctgggaagaacacagagaaattaaataacttgctctgggtgggtcgcatggctagtatattacagaattaggattcaaactcaggcagattaactccaaagttcatgttcttgactaatgtgcactttgattctcattcctcccagcgaaaggtcttaggaatgtatatacaaccaggaagtcttttccaaaataaatgaagtaacataattatactttgcccctatcctccctcctgctgcccaattctccctctgactactcatcattataaaaacatatgaattcgacaaatttagcaagtgggcatttatgactctcatcttttccatgcattggaatactgatctgagcaaaatatggcctttgtcatgaatgagaaggaaagacagagacattgaggtctgtaagaggacaatgcacaaggtattggaggagcattaaataggagggagcaattcaagctgcgaaaaaagatcacaaagccctcagaggagtaggataccggggccataaaacccagggttcccattcaaaacagccagataaaacatattccaaaagatgtagtcaattcctgaatgaagcagatgcatttgagcaggaaaccaggaatcctcccagatgtcccaaagccttgagcaagccattcctcaatgctgggcctcagtttcctcctctgcagatgctctatggagcatgctggattaaactatctttagctctaaaacctcacctcatccttcattagattccatatatatgataaagtattcataacagtgttccaaaaataagaagaaagcaaagaatttaaagtaaatgcagttattttaatcttgggcaaaataacccagagaactaagggaagagaccaatggccacagaacccatgggtcttccagccctgatccatcatctcccttctggaattgcagagcaggagcacttcgtgctccctgctgtttctcatactctgaaacttacccgcagtgagcactgatgaatatcacctagcccctatcctgtgccttcagttgtgctagaccttcaatgcctatgttgccttgtttcatcttctcaacaacactgtaagacaagattatcatctcatactgagaaaacaaactcagagaaattaagtctctggtgtaaagtcacacagcaaaagtcagttgagaatccagatcagtattattttccatttaaccttccttctgctatggcacataaccagcttttacagtgggcaatagaaaagggatacagaataagaaatgagtctagaacaagggatgtctacagagacaaagcccagggaacctgaagcttttattagctgaaagctttcccagcatatccatcctctgttaaaagcacagagtagagactgggcacagtggcttacacgtgagatctctgcactttgggaggccaggaattcaagaccagactgggcaattagtgagatcccatctctacaagaaaaaaagcacagcccgtaaacgctttgattgtttaacttaatttaaaaggaggtatcttgcattactattttctttccatgactgcttgctgttgtcttcccttctctcaagtgctccccacagctggttgttgtcctttcccatccttcaaatttcctcaagaaaatgcctctactggaaacaaatcctgagaagggcagctcctggactttcctgaacatgggacaaagtatgtcaagcatcacacttatttaccctagtttgccaacccagccatcaaacggcccaggcatgtgcatcggtttagatcttctgagaagtgggagccaaaatggaaatagatgtacaagagatttattgggcgaaggatctgtaaaggataaaagggagagaaaacagaagattggagggaacctttggactgcaatgcaggtctgacacttgacaccaggtctgacacctctgaagacagaggaggaaagaaggaaggagtgcatcacaaatttgcagcaactggcatctgtcagctcactacactcctcacagcaggttatttcttgaaaggaaatatgggaagcacatttacgtggctgccacacagtttgatcttctccaaagtcttctgcaattcaagtagattcctgcaccttgggaggaatgatcgactctctggaaaaagtggttacattttgcagggtcggttcctacaaaacctgcaaaaaatagtttgtttatttaaaaaagccaggatgtcttcaaagatacacctgtctcttgtattaatgtcagatagtattgaaaggatggtggaaaaggggtttcgttacctctaatgagtatgatttagcaaaaaataaagaacagggagaaaaagaaaatccaccagaagaacagttctgtggagaatcattatctgtcacagaattcttcacatataaaatgctcactaatatgtattgactgagtgaaccatttccatatttcagctactgacctctactttaatgtcttctggtggagaccatgcattcttcaagcatatatgtgcacctactatgtgccagacattatactcagtgttgcaaatgctgagataaatatatatggctcctgcctttaagagatgaatacttcaatgggaaaatattcagagtaaatggaaatataagcaaatatttatttttaagtgctcctatagcaggatgaacaagacactttgatgactgctatgattagcatgtaatctgttgcaaggaacataaatcccaattcaaattggcttaaatagggagatattgcttctcataagtggtctcttggaacacagttgtattttcctctctttctgtgtccaggaaagtcatctgcagcctaaacgtttctctttcttacagaaccttcaaattcatgcatcaatacccctattttttctaccaagtctcctaacactacagccttgatgatccctttcccaaggtgtatgggcagctgactaaccacctggagtcctctgtagtgcccttgtgccactcaaccaattccatacttcagggtttgttattaacaatgtcctactttctggaatcaagctctctatcatataagatgccttcagttgtaaataacgaacaaatttaactcaaagtagtatttactaaaaagaggatatctgggcgaataacaaagcccttgatgttggaaagtattggtttgattcagcatttgaacactgtcatcatttctctctctcttctgtttgccatggtgttaatttcatcctaaggctggttgtacttcacgattatgatgtctgctaacaaccatgaaaggtccacgcctcttcaggccatgtcaagagatggggagaacaagttattatgaaaagctctctaagtaaaatgaggaagtgcaattccaaaaactcctagatatcatatcttcccattttatgggcccacatgggaccatgtgctcagccctgaaccaattgctgtagccaaaaaatacggtttactaatgaaaatagccctgaaccatgtacaagagttcagtcttcttctcacaaaacacatgaatttgaattggggagatgttgatctaaataataacaaagtaaggtttttataaaagtggatgctggagagacagccacagtttccactacaacaatgataatgatgacagcaaacatttcctgaaagcttctatgcatgagacccagctcacagcttaagattcctagaatggacatatctatgctcacagcatgcctccaagaaatccagccagagaatcatgagcctagcccttctgcaagccccagctgaaacaaaaacccaacccagctcaactgagtctcctctcaccccttcccttatctctaaacacacttattttactgctgtttgcttaaagcatggggcagacataattactgaattaggcaagatctggaaagaaccccaaagccatttttactcaaacagaaatcatttgttctaaggagcccacccatcacctcctgaccttggagcttaattaattttacacaagaaaagtgctgggtgcccctgacccctcctgttggagacattcccattaagaaggttactgcctccctcagcagggacccagctgaaattggctataagggctctgtaaatctggcacttgtccgggcaagaaaactgagttttctgaagcaactggagaggaaataaaaagtaagtctcacctcagccagagttgcctccttggttcagaattgccattgtcactagagttttcaaagaagccacaggaaaagcgtctgcctgggactccctgatctccacctcctttcactgagctgactccttgatccttcagtactcatcttggctgctcttccttgaggaagtcttcttgactcttccttcaaccttgcagattgtgtaggctacaaccctctgcgtttgtcacacccatggccctttttctctccaccatgcatctaacccaactgagcaaaatggcttacttacttacctatgaccccctctagatcatgggtgccttcagaataagtacagagtgtatttagggccgggcgcggtagctcacgcctgtaatcctagcactttgggaggctgaggcaggcggatcacgaggtcaggagatccagaccatcctggctaacacggtgaaaccccgtctctactaaaaacacaaaaaattagccaggcgtggtggcgggcgcctgtagtcctagctactcgcgaggctgaggcaggagaatggcgtgaacccgggaggcggagcttgcaatgagcggagatcgccccactgcactctagcctgggcaacagagccagactccgtctcaaaaaaaaaaaaaaaaaaaaagaataagaacataagaacataagaacagagtgtattcaactttcaactacatccttaacctcttagaggctcgataattaccatggaaagaaggaatagaaggggataagtaggtagacagacacccagtagatgagtgtcttgttcatcctgttctcatagctccacaggcctcatcatagaatcttcatgacgtaaacttggagctgtctgctttcctacgctgcaaaccttgatgatgatgtggtattatttctgccttccttctccagcacagaatctgagggctcaagggaatgactggcagacgaagcctgaaggggatggtgcaatttcaaaattcaactaggaaaaccagatgtcctactcttggagttacggagtgcaggtgaggaactgcctatcacccttcactgctaatgagctcttcttcccacctttcccacaaagtgaggctgaaaaaaatcttttcagccaaattcaactgcagaaacactggcttaaacaaatgtaaagtggttcctttaatggagaatttcttagaatttcagatcattgtgtgatatgaaactgcagggtatggacagaagggtagaaaattcttttatatatatatatatatatatatatatatatatatatatatatatatatataaaattagtagccaactggatattttgttgtttatttaggagtctaacattgaattactgtcatattgaatagtgtttcacaaatttatttgtggcataaaacaagtttcttaaagagatttggaggggttcttttttaattttttttcttagagacaggatctcactctgtcacccaggctcaagtatagtaatgtgatcctaattcactctaacctggaaccaggctcaagaaatcctcctgcctcagtctcctgaatagttaggatcacaggcatgtgccaccactcctggcttttcttttttttttttttttttaaatagagatggggtctcattttgttgccaagactggtcacaaactcttggcctcaagtgatcctcccacttcagcctcccaaagtgctggaattacaggcgtgggtccccatacccggccctgtttgttttttaatttagaatttgccgtggaccaacaggcagtcgtattctccacaactagtgcacagctcatgctgcatgtcatccacctcttttttctccctcaactccctctctctttctccctgtctctctctcccagagaaagagaacataactggaaagtgagctggtgcactaaagcatcaccaccatctgtccatttcccacactaggagatacctctgtattacgcagtcccatggcagaagcttctggaggaggaaacagatttcccttgccccttcagttgaagaatgaacatcaggaccagagctttgacttgccaatgactagggtggcctggtctagtggaaactgagagcctcttatttctcgggctctgcttgacaaagctatgtcaaaccaaagatgctgtgcaggtaggacctggctttggaggtgagatctctcatcatcaccatccaccagacactcttactctaatctgtcttagccatccaacagcccacctcccactgtgctggctttaagaccaaccaggaatcctttgtccatccccaactctagtgacagtgacactatgtaagagggagacaaaccaatggagtgaaataagtgtcaatcaaggaaaagagctccttgtcttgtctgggctacccacctctgagccctctggcttgcatggcttacttctcagtgagctgagacttcagctccaccagaagggttcagtttcacaaatatcttcaccaaaaaacacctcctttgctcccagaacaggaatgccccagtgccccatccatatccatgggtcagtcttaggattgaaggagcctggtttctggctgaagctctcaccaagaggattactcaggtgtaccagacatttttagtttttttaaaaaataactttaacttttattttagattcagggggtacatgtgtaggtttattacccgagtatattgtaatgatgatgaggttagggatgtgactgatcctgtcatccacatactgagcacaatacccaatagttagattttcattccttgctcccctccctgactgccccctctagttgtccctggtgtctaccattactatctttaggtccatgtgtacccaatgtttacctcccacttacaagtgagaacatgtgatatttggttttctgttcttgtgttaattcacttaggatagtgacctccagcaccatccatgttgctacaaaggacatgactttattcttttttgtggctgtgtaatattccatagtatatatgtaccacattttatttatccaatccaccatggatgggcacctaggtagattccatctctttgctgttgtgaatagtgttgcagtaaacatgtgagtgcatgtgtctatttggtagaacgatttgttttcttttgcatatatacccactaattagattactgggttgaacagcgattccgttttaagttctttgagaaatctccaaactgcttttcatagtggctgaactaatttatattcccaccaacagtgtataagcattcccttttctctgcagccctaccagtatcttttgtttttgactttgtaataatatgagctttgttttttatctgagtcagtatgcaaaagccagaatagatctttctcaccccagtcatcagtttggacatatattggaaattcagggagcaagtttctctccaggccacttttttctatatatttcctcttcttaagtgatataaggccccccacttgtgttggtgtcaagtggccaataagaataccagtaatactcatagttataggatagtaatgagttaggtacttgatatggtctggctctttgtcaccatacaaatctcatcttgaattgtaatccaaattgtaattcctatgtgtctggggaggaacctagtgggaggtaattggagcatgggggcagttcccgcatgctgttctcacgatagaaagtgagttgtcgtgagatctgatggtgttctaaggaccttgtccctctttaatctgcacttctctttcctgccaccttgtgaagaaggacatgtttgcttctccttccaccatgattgtaagtttcctgaggcctccccagccatccaaaactgtgagtcaattaaacctctttcctttataaattacccagtcttggatatttcttcatagcagtgtgaaaatgggctaatacagtactacactaagtactttgcttatataatctcatttaatccacatgtcaacctaggaggaaatagatacaagtatcctcatctcaaagatgaggaaatcaaggctcaagaaagctttagtagttgcccaaaatctgcatcactccaagttctgtactttaaatcaatgtgttatattatctctgactcctgtaatgagcctaaagagacaaggggatggaagacccagatcttcccaagggatgaaagactgaacaaagcattctgccccttacttcttctgactccccatccaaacttatttgtcagatgaaaatgggcaccgaggtcgacgttgaaaggaaaagtcatgctaaaagagagcctagtttggaaaggggtgactaagacatcaggatataaatattttcttgatgtaagcataatgtgtgaatagtgttcttaattctaagccctgaggttttttggcatcagccagactcacaaccacagcactgtcaggtagctggggtgggagagatcaatggtcagccaaagactcctgttccccttctgtatcaataaatgacagctgaagagctcttacccagctaagggactacatttctcaggctcctttgtactcatctgtggcaccaagttgtggaatgtagacagaaataatctgttctactttcaggcctattggaacctcacacactgccctcagctctctccctctttcaatataatggctagtgtcaatgcccaaatgacctaattacccatgagaagcccaccttctgccgccaattagactttatgggagtaagaaatatatttcttttatgtcacatcagtgaggttttgggttttctccgtcatggcagctagcaataccttaactagtacagagaccacaccggcttgatagacttgggctccaccacactgaaaggaccagttttctctcaagacaaaagagaccttgaggacctcagcctggacccatatctctacgggttataggctaggtccctaaccctaactcatcctatcttactctgaagccccatcttaccctctcaacaaatgtcttcctgttgtagacagcagctagcagtccctgaacccagaaaacttcctcttcagatctctgcaaggcctaaaggatctttcaattgcatgaattcaaactcactatccacacattcccctcatactcacacccattcccagcaaattgtccttcactactctaagtagaatctctattgcattaagccatatctataccttaatttaatgttttataaattgtggaatgctatctagtattgtgatggtaagttgagattaatcaaaaatttcaaaaaatgaaatagaagagaatacaaaatatcaaaatgcattgcacatagcaaaggcacattttgctttgatatcaggatataaatgttttcttgatgcaaacataatttataaaaagtgctcttatttttcttatttctcaacagatacagatacttctgtatctgttttgttatacttctgtatctatctatgtgtctgtctgtctgttaatccatgcattcacctgttggtctgtccattcatccatttattcatctatccacccattcatccatccatccatccatccatctatccatccatctatttatctatctatccacttacctacctatacacacacatatatacacacataatatatgtataataagtcacaatgtaaaatatatgtcttactaattatttcagtcaaaaacgtttgaaatctctttcctgaatgatatgtcccctcactctaataaattcaagtccttccttttaggggtttcttctttatctaagattgagtttccccaggatcattgtcagggatactacatatactttcttatatcaaatcagctgaaagctttaatgatgcatatactttcctttttctttcttttttttctttttcttttttttaatttgagatggagtctcattttgtcacccaggctggagtgcagtggcacaatctcagcccactgcaatctccgcctcccgggttcaagtgattctcctgcctcagcctcccgagtagctgggactacaggtgccaccacgcccggctaagtttttgtatttttagtagagatggggtttcaccatgttagccagaatagtctcgaaatcctgacctcgtgatctgcatgccacggcctcccaaggtgctgggattacaggtgtgagccactgcgcctagccatactttcatttttcaagccagcgcaaagctttaaataatttaaaaatgtggacatccagttcatttatgattcctaaaattttgttcttttcttctctcctctctttaaagtgtgttgcatctttatctctgtctggagaaaattggtcccagccaagttgtagggttacggcttcaaatatacacatgcttatctatataatgctgtgtgtatcccttgtgtccaaaagagtacaccccaggatgatccacgtggctaattaagagtttgactcatatatttttgataagaaaatattggggaaaagtctaaattatttataaactaggattatgtattaaaagcgaattcaatatacatgtgtatataacaaatatttattgagcaactactgtgcagcaggatgaagataaaatggtataagaagagattcctatttttcatgtaccttatggtttagttattagaaagttgttttactgccaataaatataagggagaaaaaaattcaaaattatcaaagtttttaatagggactaactcaccaatgacttcgatgtttaatgaggccaaaactcagtatttggatccctttgatgctagtatcaaggatgttgattttcttaccctcctggtaaagggaaactggatatgctgaaagctccttggcattaaaagccaagaccaaagacggtaatgaaatcatggtgcactcaagtcatcaccaacagggcagcagaggttagaggcatccaattatagggagcccctgactcatgcttcctcctggttccctgtctcagaggcagctgagaggctggtcttggaagtatatctgtacagatggttgatgtctaattaacaagggacccaataacatctttctgaaagtcccaatttgatcatattctcttccaaccagttgtatcgcttcagtggcttctcattgctattggggagaagactgaaatccttaagcagtcctacaaattcttccataatctggatgctgcctgcttggctcctgcgtcttctcctcattctctggagaattcaattgcacataccatataccttcttacattgggcatttgaacatgcatgccatctacctgaaataatctctcacttctttccttgactttgtttcatccagttaatgcactcatcttccagacagaagcctagggatcattgccttagacaagccttcctttaccttcctggactgagtcaattccccttattatttactttaatgccaccacatataacttctccatagcactttaacttaattgtaatgttatatctttgattaatatctgcctgagggtaggaataatgtgttttctattccctttcattattttctttctttcattgatgcctttgggtcctagagctgtgcctggcattgagtagattctcaatagcaggttgttgaataaatgcacgaataataatgggagtgtattgctaacatctggaacagcatagcctagcaggataggctgcctaaaatttcatttggggaggaaaactaaagacgacttcaggataagtgtctagtccactacacaaaagaaacacaacctgaaaacagatagtgaggatgaagatcactccttcttgaatgggtagagagcctcttctccaaacataaaagctacagtgacatttcctgggttccattctgggtgatgaaagggaatgtttgcagtacatggttgcttctcttaaacatattccagtaatgtcttaaggttaagagagctacaagtaggttgagagaggcaggctatattttttgaaaattagtaagagaagggtaagatcagtgataaaagatctcttacactttgaggagacccattttgctagtgacattggagtcatggtcacatgggtcccttccaggctgctatggcacaggacagctgggctgagaggctgactggaaaagcttggatttcatgagtaggttgaagagaaagacctttgtggatctcagatgggaagacaagagttcccactcatgcataataatcatagtgatattaaataccacttactgagcatctattatgtgttaggtactttaaaactttatttttaatgtttaaaacagctctgaaagttcaattttataatctctatgttacaaatatgaaaacggaggctcagactggttaagtgacttgcccagctgctaaatgatagaaccaagactcaaaagtggcttgtggttgtggccatgcttcttcactcacagaactggccctgggggctgcccatgaagacaaatgaacttttgcatagtgtccttaaatacaaataaattacatggacattgcaacctacttttcaccaggtatcaaagacctggggtacattcccaacacagtgtgctttcttcctcctcaattccctttgaagttagtgggaagtcagcacctggaggctacagagaatcacagtggggctgagtgtccatcttgattttacactgtccatatttttaataaaataatccagaatcaatctctatctatctacttatctacatatctatcttttcccaatttaatgcggtagcaccaaataattttctaattcaatgataaaaattaaactttctatatgcaaagtaggtcaaaaatagctgctttaattatttaagtaatatccaaacaggcaaacatcaaaagaagctcaagttgcaacacaaagaaagaaaaaaaatctttagaatcagcaacttttctaaggcaaacaagatgatctcagacacatgcacaagctaagtttaaggctttctctttaaaaaaaattgcaatttcattgatgataagatcattaataatactacaacatgtccacagcatattcttatcaacccagcattctggtcgtatttacatacaggctatttattgctatggggtttcaatgaggaaaaacaaattcattaaaaagcctagaaattagtaggaaggactgagatactgatgaggttccttgattctaaacatggctggctatgctaacagctcctttggaatgcttggccctctagaatatagccagaaagccaggtgagcgttttccgcactaaatgcttattccctacattctgcatcattttgtcagcataaagtctcttctctggcttccctcctttaaaatatgagcatttctatggccctagaagcccattcttaattcaaatcttttctacctaacatgtaattttttttttttctctcctcaactaaacctctctgaagcatcaggcactgtattgggcactgaggaataagaacacaaagagaacagctgttaaagatctcacagaacccaaacaactaaggcataatcaataaaataatagatgcatatccagggcttcaagaatacaggaaaactgaaagcttcacagaggatatcacatttgagcttgagtcttatgagggaaaaaataaactagaatctacaataagaaagaaggcatctctggcaccggaggcactctatgcaaaaacatagagaaatgagaatggcatgttcttgcaagaaaacgctgagatggaataaggctgtctcctaggggcggccagaaatgtaactgtacacgtatattggggcctcctacatcatctgggacttggttttatctggagggcctatgttgacaaggattaactgaccatcactccgtaaagtcttgtacagcagaaatttgggttctattctgtattatgacttactatacaactaagacaaattccttcccctctctgagaacatccactgcaaatcttaaatgcctccccagaatcgttccccagtggctcctgcctcccaaattgtgctgtcactgatgggtgggccagccactttccctgggaatgctgagccctgggcctgggccaacaagccacatgcccagagttctggctcctcctccacttccagacttagcaggaacaccaatctgccttggtggcatctggcaaacagaacaaacaccaaaaggtcaggtgacatgtcccagaaatcagggaattaactgttcgtgggctgagtcttgactaatgggaaaaaggagatggaagggagccaagcagataacatttcctctttcctgccctgcagactactccatttcttctgcagccagtccacccaggttcttcctctgaggtgacttggtctattgtgaaggagcacccatgaggacacctcatttcccattgcttcccaggattccttgccctactttcctttccttaccttctccttgttctgatctgcaccttccaagtcaaacggataagaccctcagttcttgcttcaggctctgttttctcaagagcacagcctcagcctgtttttgttttcaaaatgagagagatggccaagcaccctcaaagttacttctgggtctgagattccaaagtcttagttctaacgttcaacagaaccttgaccaagacttttcacaggccgggcgcggtgtctcacacctgtaatcccagcactttgggaggctgaggcaggcggatcacgaggtcaggagatggagaccatcctggctaacacggtgaaaccccatctctactaaaaatacaaaaaattagctgggcgtggttgcgggcgcctgtagtcccagctactctggaggctgaggcaagagaatggcgtgaacccgggaggcggagcttgcagtgagccaagatagcgccactgcactctggcctaggcgaaagagcgggactctgtctcaaaaaaagagaaaaagagttttcacaaagcaggcaactcatgtccatcatgaagtatgcaagtcggggcaccactttctgcattgggaaatatttctaagaggtttctagaatcacccccactttacatatgggggaactgaggctcagaaagtttaactcacttgcccaatgccatgtaactaaaaagaaccaaaattcagactcagacagtctgattcctgagcttgtgttctttgtcactactgaacactgtgtctcttagactcttctggatttactcttcaaacctgattaaattttccatttcttaaagactagaaaaaaattcaaaatggaattatgggatagaaaagcaaaatgacatctcctgggctgcaccaaaaatacaagggagaagggcaagaatagtatgccgtatcatttaaggagccaaggtcatatattcaacaaccagttggttgtcccacattttagcattctttcccttaacttttccttgtaagagaaatctgtaaggcagaaaaacattcttagtaagaaaaaaataaaaccctgatttgggttatgaaaatgtagctgctgtaaacccaaagaaaacatgtcagttcaactccacctaagatcgttttatgccccagtataaattctaacatgagcttcaggagtggtatgtgaatcttgtttttgttgttgttttttcttttttctttctttttcttttttcagattcatgggtctcttgaagagctagtcatcctagcctattaataattttaatcttaatttctttcccacttctcctactctctccaataatgaaaaaaataagaccttagccatttgtttcccaaaaacatggagcctgtttcatgactattgggagcagatgttaacatacatcccccaggagtcagtgcaggtttgaaaccataacaggagcagacaacttacctccagcaaggctattaggtacaaggggtcagagagatacaaaacaggtattcccactggccaccctgtccctgaaatgcctcgccttccgtctacaaccccagccttccacagggctcatcatccttcacgaatgacccccaatcttctccaagtaaatgatttgagtttctctcatactttctcagtgcatgtgacagtttaagggaggttaccaagaaaaattcttccatacccaagacaattctcccactcacacttccatacaagcacacaaatgacctcatggtttttgaggaaggtcagctcatgtttcggagtctaataatgcctaaagcaagagcaaggaggggtgttgtggctgtcagaggcatgggaaaccacagcttgttcaggaatcctcaaagggcatgtgctggagcttttcaggattgaggaccagaatccacatggtcgaagacaatctcaattttgtatatctttgtagctttagggttttgaacactttagcttcccaggaagatacatgagaggaaaggttcgcaacaagtattgaatgaattaatgtatgaaatgaatgaattcaattgtttccccatccatgataagtacaaattacttcttcctcgaagacaacctgatgttgatgtttttgaggtcaggcagcccctttgtcatttacaaacaacagactttaatctcctcgagcttgttttccttaccggcacaaagagcattatagtctctatctcaaagaaccttgtgaatattgaaggggctctatacatataactacctgacacacagaggtgcttagtagttgctagtttactttccctctttgccttctccatgttatctgaattccctagtccataatcctggttccaccaagccaaggtcagtgccttggggtcctgtgccagtttctgaccaggaaacactataccatagagtcctccagatcgcaggctctgaaagccaacttttttcacttgaataccagctctatccttactagctgtgtaactttgggtaagttacttcacctctctgaatacctgcttcttctccatctttcagatggggacaataatagtacttactttgaaaggattttgtggacacatgtagagtttagaatcatgtctgagctgagaactgctcaaaaagtgtaactggtattatgacgtctatataagtctactctacgtgaaatgtgaacttctcaagccaagaaccaaggtttcaatccctcaggcccacagcagatattttgtcatctagcctgactctctaggcactttctgctatttgagcaaaggctagcttgctctccttaccctgtactgcccaccatctcatctttccaaacctcagagaacttgggaactttctgagcaggcccaggagtttgggaagtgcagcatctttggagcacatagcaagcctctgaggcccctcttcagaatcccaggcctttgggaagcacacagtgaggccttcctgcaacacactctcctcctgttaatgaaacccttagtttgggtcaagtttcatgtggaattcatgacatttttagcttcatgacaatgcctgaacctcacctccaccccaccccatttttctgtgtgtgtggttttttttttggtgaatgggtgcatgaagggcacaataaggtttattaagtaagagacagaaatgcttgcaaacctttactgctcctcccaggcccataaacagttcctcaatccttctttgcaaggtaataaaacctggtgggaggtgaactctgggacccatggggtaagggtgggtttgcttccagcctgaggctgaaccccagggtgagcccatgcagcctccttccctgctccatcctcaatgggagggaagtaaagggagaacccatagagctgagctgctggaaacccaaaaagcctgcaccccctcagattgcctgtaaaaagcagagaagtgcagatctcagagaggctagaagcagcctggggacccaagaggaacctcgggaaactctgcagtcagaggcccttcatgaggaaaaaggcagtacagagcagaggagagatcacagaaaatgagccagagtgctgtgttctgatgtgtgctctgatgcttactggttaaggggccctgagcgagttccctgacctctctcatcccgtttcctcatctgcacatgggaataatgagatactgggatgtatgcatgaggtcatcaatgcaaagcaactcacactctgccaagaaggacccaggagaatggcatggcaaatcattacttaaagagtgggttcaacacacaaggcctgaaggattattgacatgaagctatgtggagttaacgatagcaaccagagaagttacccgccacatgtatgttttggtgataggcttgccatcttctcagagagcccagaagaaggcataaccaggaaaagccctcaaggatattggcagacatcaggggtgctaagaagatgggccagaatctctccaggggttggcacctgaggagtccacctgtcattgcactaccagcttcctcttctggcttgtgcgcagaatcaggtggccctgattttgcccagtgatcatcccaagcccagagccagcagtgcctggacctgggctaggatggacttgtgacctgtaaccctgtggcatgcaagacagcatatgatgatgcactgtagcaaggagggatatagagatccatgtctgggctcaaaaacacattggcacaaatagaaaatgggaattgcgttttaagagtcacactcataggccaggcgtggtggctcatgcctataatcccagcactttgggaggccgagccaggcagatcacgaggtgaggaggtggagacaatccgggctaacacagtgaaaccccgtctgtactgaaaaatacaaaaaattagccggcgtggtggcacacacctgtagtcccagctactcagaaggctgaggcaggagaatcacttgaacccggaaggcagaggttgcagtgagccatgatcgtgccactgcactccagcctgggcgacagagagagactctgtctcaaaaaaaataaaaaagagtcacactcatagtaaagtgtcaaggcttctagtcatcagttatgtcttttatgacacttgactgagttaggttttttaccttcaatcagttaaatttccatttgtaaggcatgttaacaaaaccacatttcatttcaaacattcaagggattctctaatagatcactggtgtcttccttttggaaaagttacaagaatgtgcactccgcccagttgaaagatgaagctaaaaccagaactaaaaattgatgaaaaaagtccgctagggagcactgaaatcaattaaaatacaggtaagattaaatcgttattttaatctttgtaataaaatcatgtgccagagtcaatattttggagaaagtcagtatttaaagtaaataacaacaaaacaacagcagcaatgctaattatataccaatattttgtatctaaaattacagaacctgttaaaatactgcaacatggaagaggaaaatggtagagaagaaagtaaaagtatgataaaattcttaagcaggaagagctgagtttaatgctggatacataaattataaaacaataataataataaagaatataaaggtattaaaaacaccccacaaaaagcaagaaacccaaggaaaagataaggacatgttaaaataaatttttaatcaaggtgatagaagagtgaacataagagttataattttagatatatctgtaaaatatctgaaaaaaagattctttaatcagaatcaaaacttaaacagtcctcaaaatttttgaaactgaattatcagttaaaataaaattaagaagtaaataatagtcacactacttgtatcagacaacagattaacttggatagaaaaacccactttcaaatagtaaaaccccaatccacaaagaaaaaatgagaaaaagatgcaaggaataataataacaaaaagttaagtgttcatctctcagtttttaaattatagaagattttattttcttcatttggtttatctgcattttctacattttcttcagtgtacacagcagaaaaagagttataactttccctttattaccctctccatttccaaataagcaaatgcaactcaggtgtcatctcttcctggaaaagcccctgacattacaaccccactcctaaatgagccctgtgaggtacccttctcagggatgtgccaagccagcccccataaactagagagcagggtatgcacacctcttcccagctccatgtgcagccacgtcaggttagtagcttgaaatctgccagggtggaagcatttacaccatgggaatcagtagatgctacaaatcaagatctctcccacctacagccggttaaatatttattagcacatcactgtttgtgtttctagaaatctgtgcatgtccttccataatttttatcatcttgcactacagcgtttaacttgcttttttctaccacaaattcatgaacacctaagaggcaggacatttcctatgttatctctcacccacaccacggcacctagcacatagctggtggaaggaaagagagaaaagagggaagggagggagaagccaaagaagggagggagagagagataaggtaactgctttcttccttcaaatgtaataaaattggctaattatttataagtatcaaccacagcccattctttggagcatgaaatttttccaactatcaccaagagaaagatctaggtttgcttgctcctgatttctaagaagaagagggctttgcaaagcagccccttacctctggaacttccagccagactagaaggtagaatggggctattattgaaaagacattcctgaatacaaattagcatagcaaatccaagttttgcttaggacatttcctggagattaacaattttcaatctgtttcctcattcagcacatgggaaacatgagaactctcccctcactataccttctgtcatttcatcgaggaccaagtattcagaaagggcaccataaccataaagtacttgaaaagtgtacctatttggttcctcctcactttcaaaatgtattggaatctctttcctgaaaacaaacaaaaaaaatcattttgctattataccctaataggtatctttttggtagtagcttgttcatgcttattaagattaggtattataatatcgtcattaatataaactcctcttctccatgaatatgtagacccataacagaagaagcaacagaggccaaaatcctcatgaaattaaacaaagcaaaccataaaacagtgggaagctcaaccggcttagccagtttttctgatacatactagatataaccactgagctgttatttccattgtcctattcaagttccttcaggttatgtgtgccagtatgtgtgtatggcagcactgcatagaggagagaaggaaatggaaaccactaattattgagtagctactggactcactcactggctcaacaaatattgactgagcgatgtgccagcactggctcagcccctggggatacaagtgaatgagacaaacttttagagtatgcaatccattggagaaatggggcagagccgtaataagaaacacataaacaacataattacagattttaaaagttctagtaagaagtgaaacaaagtgttgtgatgcactgtaaagggagagggatgtagtatttaggaggaacaggagagagttctctaaagaggtgacatataagccaatacatcaattaaaggataacaagaagttggttaagcaaaggtccaagagagaagcattcccagcaaaggaaacagcagaggcaaagaccttaaggtacaaaagaactgagcacatgcaaagatcataaacgaggtcagtatggctagagaggctgagcaagaatgagtgtgggaaataaagttagagaggcattcaagtactaaacatataggacattataaagagtttagatttaaatgtaagtgcaattgaagcatttgaagcagcaaagagatatgggctgggttcaataaaagttttcatctgtatattatatgaagagtggagtagagggtgcttggataagagctgggagaccaattgaactgctgcatggacttcctttcatcatattctgggatttggaggcaaaaaaaagaatttagtgcatgttcactgaatccactgtaaagttttcaaatttgaatccatttgtccaaaggaaacattcagtatcttcacgcctttctcatatgtctggctgtgaaatcttgggcaaattacatcacctctcagaacctcagtgtcttcatttgtaaaagtagtttagctgaatcttccagagtatccagtaaatgttatactccttaatttcttggaaaggaaaatgactcagatctactggaaatagaccaggtagctccaggcagttccctgggccaggacacagccaagcttgggtggagcctcaaaggggccagggtggagaccaagagaggcctagatacctgattatgcatgcaaagtcccacatcctagacacaaaccttcagctcaggaatgtggcttaggcggggcttgctagcaatggaaacagcagagagaaaaccaggaggcactagaagaaaaaaacaaattaatatttaaataattgtaggttggagagatgttgctaaattagcaagcaaaggcagaaagcatgaaggcaaagattgatagaatttatttcatgaaacatccaaggctatcttagaaatcaaaaataaaatcatgaataacccaattaaaaatgggcaaaagacatgaacaggtatttcctaaaagactgagtgtttctgttactctggagaacccagactaacgcataaacaacaaaacagtgtgttagaaccaaggatcatgattaatcaattctgcgtacctgagatctgaacaagaagaaaaaataagaaagaggaaaagataaacccttgcaaattgttaaacagtgttagtaatcaggaaaatacaattcaggacaactatgatctacaattttacacaccctcaactggcaaaaattgaaagtttacaatactaaattatggagaggatttaggtctacagaatttcttacacactgctggtggagcatgacatggtattaccactttggaaaataattgagtagtgtcttctaatagtaaacatttttattgtctatgacctagcaactctactcctggatgcaataatacacatatatcaagacacatagccgggaatgtttagagctacaatgtttacagtagcaaaaccctagaaaccactcaaatatccattaatagatattcacaaatgacagacgcatgatatataatatgtaaaaatggtatatttagccaggtgcagtggcattatacctgttttcccagcactttgggagaccaaggcaggcagatcatttgagatcaagagttagagaccggactggccaacacagtgaaactccatctctactaaaactacaaaaaaaattagctgggtgtggtggtgcacacatgtcatcctagatactatggaggctgaggcaggagaatcatatgaacccaggagacagaggttgcagtgagctgagattgcaccaatgcactccagcctgggtgacaaagtgagactccatctccaaaacaaacaaacaaaaaggctatctttatatattatatatcacgcatctgtcaaaatgaattaagcacaatgatgttacaagtaaccaagtgataaattttagcaaaattacattaaatgaaaagactaccaaagattgctcacaagttctttaagttactgggaaagttatatatttttatatcacaagtagttatatgggttttatgtaagtaaaaattcattgaactgcatacataatgttttgtatatgttatttgtatgtacattataaatcaattctagttgttttttaacgaattgcatacccttttttggggggtctggggtgatggagtctcactctgcggccagcctggagtgcagtggtgcgatctcggctcacttcaacttccacctcccgagttcaagcagttctcctgcctcagcctctcgaatagctgggactacaggtgtgcaccaccacgcctagctaattgctgtatttttagtagagacggggtttcaccatgttggcccgggtggtcttgatctcttgacctcgtgatccacctgcctcagcctcccaaagtgctgggattacagtcatgagccaccgcgcccagctgccttttttatgaagctacaaaccacaatttttaaaacctatcttgtaatactaaactccacttctatttaataaaactaaataaaaatgaattcaggatgataatgacctcagaagagagaaggtgagaatggattgaagggggaggaccaaccatgtttatatatggcttcttgtgaagagactagctgaattggggaaggaacttcacagatgtctatttaataatgtaataacattattaaaattgctaaattaaacaaaattacaaacacaggcaaaacaactaaataaaaggaggctgtgatagttaattaggaagctgtgatagttaattttatgtgtcaatttgaccaggccatgggatgcccagatattttgttaaatattacttctgggtatgtctgtgatggtgtttctggacgagattaacatttgaattagtaggctgtaaagaagatcaccgccctcaatgctcaatgttaggtagacctcatctaattcgttgaaggcctgaataaagtttgtgtaagaaagtattttccctgtgcctgcctgacctcaagcaaagacattagtgttctaccttcagacccagactgaaccacatcatcagctctcctgggtcatcagcttaccagctgcagatcctaggacttctcagcctgcataattttttgagccaatttcttattttagatagatagatagatagatagataaaatagatagatagatcaatagatagaaaaatggaaatatatgtatcttaataaatatagagagagatagatggatatataggctatatagataggcataaatagacatgaagatagatgcaaagatacacacagatatatgtgtgtgtatttgtatatatatgtgtgtatatgtgtgtgtatgtatatttacataaacacaaccacaaacatatcctattatttttatttctctggagatcccagactaatacgaagaccatgtatgaacaacaaaactatgtgttagaaccagggattataattaatcaactctgtgtacctgagttctgaaaaaaaataacaagaaagaaaaaaagatacgttttactatgggaaacaaaaacagaataaaaattctaaatcaagtgataaacgtagaagaaacattttggtatctatacatgtcacagaaaaaaagttaatactttgaacatataatgaggaattccaaattgaaaaggaaaaagcaaacccttcaattgataaaatgtgtaatacacttgatcagaatttttttaagtaaaatgtaaaaggcaaagagaaaatgttaaagtttacttagaaacagaacaaaaataccttttttacatatatctgaatatcaggagccagatttttcattattatagaagtttacaaatataaaaatgaaaatattagtgtttgtacacctaaaaggcctctatacccacagtattcagatcttggtttctaaatactattctcctttaaagtattgaggacttgttggaaaataggcagactccagggatgaagcagaaaaaaaatagaagataactctgaaacatcatgttgcatcaggaaagaagaaagtgttcaaagaatgatagggacatatcacaaagatatggacgccagcttgaagagactcccactagcaacatctaggacaatttgagcaccaaaaatggatgataatccagtcaataaaataagaatctaggagtctgtgataatgtaaataatcaattaatcaatttgaatgaagaagaaagtcttccttacagaatattgccaacttataaatgtaagaagaacaataaagttagaaaattattgataaatgctagatctaggggttgaatgtttgatgagaaacagtgtattgtatagtctcaaataatttacctacaaagggaacaccagtggaaaaccagtaaacttataatggagaatcagacagatacctactgaaccaagtgatcaaaattaatacctctaaaaatggacaaataaatatcatcacaacattactcctttagtttttctgccaaaaaatgcataatctgagtcaaccatgaagaaacatcagacaaacccaattttagggacattctaccaaatatctgacttctacccttcataaatatcaaggtcaagaaaggcaaataaacagtttcaaaataaaaaagaccaaagagacatgacaattaatgcagtgtgtgattcaagattaaatcttggaggggaaaaaaacaaatcattaaaaagaatattagacaattgatgaaatatgagtatggactgtaggttagataacagtattgtattaatgttaatggttaggtaagaggagtgttttgtacgttctcaagtatttagtacaggggcacactgtttctaaattttgtttcatacaattcaggaaaaatttatataaataagatagagttagaaatatcagtgttatgtgtagaaagagacaggcatgtataatgattatacacacatacatgtacaacaagtgaagacaaatgtgaaaaggaagcattgatgaatctatataaaagatattcaagtgttccttatactcttattgcaaaataaacagttgctttacaatatttacatacacatatatataaacagctatactctaagtaggtgggaattcaaggaagtaggtactataatatactgccagtggggaacacgtaagtgggtattacttttctaaatgtggacagttggcaatataaatcaaaaccaataactttgacatggcaaaatagaattatggagatggatgtgcataaatccagagctacaattctcataatactggaaatctaggaagtctagagataacacaaatgaccaataagaggaaaccaagtgaacaaattgtggaacatccatttagtggaataaggatacaatccttaaaagttttagtgcagaaagctattttattacataggaatttttatacactatattaagtgaaaaaagctagtagtaaaaaagaaggatgtgtaatttgaaccaattgtgcaaaaaaaaatacatattaaggtagaagacattattggccctagttcttgactcctttctggatctacatcctttgccattgactttggagttagtaatgggccttgctttgaccaacagaatggggctgaaatgtgtgtgcaccagtcccaaccctaggtcataagtgccctcacacattcccactcattctcctgcatttctgcccatctccatgagaagaatataactggactggtggctttcattcccaggaggaaaatgagagccccttggagtagagcagatctacacagccaagtccagcctaggtcagttaacccctagctgccccttagattcatgagattaagtgactgctgcattaaggcctgagatgaagatggcagcattttctggaaatagctgattgctgtatacctgaggtacacacctcaaaggctttttaagggctacctctgggttgcattattacagattatttctattttctttttatatggtttatctatattttccaaatatttgaactgcatatgtattgttcttggactttttttaaaaatgacctacaaaatgatgacaaaagtaattctaatgagctcaagttcagtggatctcaaaggattcctggaaaatgagtttcaacactcaaagaaatagatagcttcaatttattaaatgtccattataacccaggcactttaataagcgcaccctctttttttggagggggttgcttcactatccacaaagcaaaaaagttatataagatgatttccattttagaattgagaaaactgtgaacatataagttgagtcagatgcctgaagttactcaactataaagtttcagagctggaattcaaacacaggtgtgcctaatgtgaattcaccatccctgattgatacagagacctctcttttccctgatccagacagaattctgctgttgagcttaataactcagccctctatggggtcctgaatgtgcagcattgctctgttactgtgaaattacccacactatacacccacctcccataaggtgggatagtaggttaagaaagctgcaaattctttgccacttttcccattcataggtggaatctaattctcctgcctttgaatgtgagctggccttagtgacttgctttaccaacagaatgctgcagaaatgaagacctgggcttctgtgatgtcctaaaaagattttgagcttccacttgaccacttggaaccccatcccctaactctgaggaagtccaagccaccctttgaagaagcccacatgaagagaattgagtcccccagcagacagcccctgatcagcttccagcaccaaagtgtcagtcctgtgagtgaaccatcttggaagtgaatacttcagccccagccccagttaagctgcccccagctcatatcatgaagcagagaggaactgactcaccaggccttgcctcaattgctgatgcatgagcaaaatgaaaaattactgttgtttgaagccattgagtttggtatagtttgttgtgtagcaatatatgactgaaatagtatcctttttttaagtgatgaaggtagggaggaacaaaggaaaggggggagggaaagaggaagggaggaagggaagaagtatttgtcacatcatttcatggagaaaattgcataaataagtaaaattcttagtaagcaaatgcaccctgactcctgagcctcagtgaagggtgcagttctagctcagcatcaggctcctctgaggctgctctccttgtcagcaaaatcagattggtaaagagcctgaagttactgatgcaaacctgcatttcttcaggcaactgcaaaagcaatgtccacagtagagaggcaaaagctatgtttatgcactttcctgtgtatttatttatcctggcacaggaattttcaaacttgtcattttaaacccaaggaatttttcatccattttggaatttcaatcaccatgttactgaataaaggagatgatgtagggacagccaagctcttctgagtggcacaaatctagtccctggtgacctgctgccaaaaagcattcaaccaaaggaagctagaccctggccatgaagtggcattcttgtgcaagatgcttatctgaatggcggcatgcttcttgcccttgaattgtgattaaatcttgatagaatagactcttctctcggggtctctaatttctagagtggtaaacagcacctaaaagtccatctggtccagacacctgactctaggctgagaaataaataaatgctccaggacaacttgtataccagtcatttgcccatttgttctcagatctcagacccttcctctgctcagctctatattgtatatggctgagttcttaaaattacattccccaaatctctcaaaactggcttatgattagggatggcccaccctaatcagaggtactggtggaagactgaagaagaggaggaagggagaagccagagtatcttccccatcattctttgacttaggccagtgactggaactctcctggctcccattggtgcaggatggatttagctcccaggctcccaggctctgttagctccacctcctcccctctgcacacacatcccaagtttaagctattgatttcttactcctgatgttctggtgccaataatcatgtttctaccactgatttcttagcttcttctactccagattaaatgtttccaattccatcccatactttaaagctgctgaggtatcttacaggataaagaaatcctcatcagtctaccctccttcaacctggtacaattatggatccttcttatccatgagcccagctcgtccagaatctcatgaggtcatcagggcttggatctgagttctttcagttagtatgtacttagctctcaaaatgctccattttagagttaagtcttcttctgtgggtaagcaactccaggtcaacttacataagtccctgaaagttttggactgtgctgtgtatgtatttttattggcagcaccctgccaccatcaggcatagaaggaaagccccggtcccattcactcttccccctcccaaccattcatccatccaaccatttatccacctttccttcattccatccaaccatccatccatccatccattcatccatccatccatccattcatccatccaacccctcactgattcaaaggatcttatagattaagtttagagatttgggaaatagaatgaatgtgaactaaaatacacttcaccactttttacttaactgtgtggtcttggcaaattatttacatttctgagtcttagtgtgcccattttacagaatatgaactaagaatgaaataaatcatttagctactccaagccccagttttctactctgtaaaatgggatcagtaatgatacctacccattggtggatattgtgaggaataagtcagacagtccctataaagtgcctaacatatgaccttgaacatagcgaacagcaagtaagtgtttgttgtgatgatgatgatgatgatgatgatgatgatgatgatgttgaagaggaggagaaggaggaggggaaggacaaggaggaggagaaggatggagatggaagaggagaacaaggagaagaaggaaaaaaggaggaagaggaggcaaggaagatgatgctattcccagaagcaattcacaggtccctccacctggaagtgagtccatataaactttgaaaattcctatgaagtattctgtccatctcctgtggtccaagcaatgccaaaggcccatatggatcagaatccatgaggatagacatggagaccaaagtcacatgaagttgaacaagtcactgacggaccaccagtagaggatgccaaccctctgtatatgagtgccaaaatatagccctctcagaatctcagccctctctgtgaaaaggcaaagctaccacaggccagacccaacttacggtaacacaggaagactggattagatcatgtctacaaagcactttggactccttggaggacagtggtctataaatagcaggtggtggtattattattaatcaggccaaccttttattgaagctaattgctactgatgccaatgagacatttatctgggtatagccaaagaatcagactctacagcagtgatccattatttattcatcattagattagcggccaaaaaagaaatgcatcttataaaaagcaatagtatttattgtctacaagaagcccaaaagagaaaaaaatatcatctgtttttctggtcataaagacttcggtcccaatgccactcctggctgtgactgggtacatgataataagatgaattccttaacatttctgagccttcatttcctctacttcaggggttgtgaagatgaaattaggtgatgaatacttgtcccaagcccactgccaggtgtgaggtaaaggcgtggtagcttccaaggcccattactttttttttttttctttttttttttttttttgagatggagtctcactctgtcgccaggctggagtgcagtggcacaatctcggcccactgcaacctctgcctcccaggttcaagcggttctcctgcctcagcctcccgactagctgggactacaggcgcccatgaccacgcccagctcatgtttcgtatttttagtagagacggggcttcaccgtgttagccaggatggtctcgacctcctgacctcgtgatccgcctgcctcagcctcccaaagtgctgggattacaggcgtgcaacaccgcgcccggccctaagacccatttctaatgcttagggctcatcatttgttaccgtaaactaaactgtcttgtccacaccatcctttgcctcatgaagtctgggcttttattaccaagaaaatgcgtccagtttgggggccaaagaaagagcagggagatatgtcaacagaaatccaaggtaaggtatgcattatgccacgaggccttactcttctttgaataaggttgactctccactccctaattccctgtccagctatgactccaaccaatgaagaattactgtggccaatgccatacttttctgctgcctgaagtctagccaatagctgccctcctcacccatctcttgcttgctggtgattggagggggaaaaaaatggctcacatgtttgaactgaccaatgagtgagagacaaaagccacaatgatagactggcttctaggtctgcataaaccataaaggtgctcccaaataaacactgttgacccaccgtctgtgaagaatcatgggttaccatatcaccacattgtttgacaatctccctggggctcagcagagaatagctgaccaaaaaataaataaataaataaaagaagaagaagaagacggagtcaagatcagcctgggcaacatagcgagacttcacctctatgaaatgtaaaaaaaaaaaaaaaaaaaaaaaaatagccaggcacggtggcacacacctgtagttccagatacttgggaggctgaggcaggaggatcacttgagcccagaaatttgaggttgcagtgagctgtgattgcaccaatggactccagcctggatgacagagcaagaccatgtctcttaaaaaaagaagaaagagaagtaagaggaggggaaggaggaggcagagcaggagaaggtaaaggaaaagaaaagagaaaaacaagaaagtgtcggttttctgctaacaaaagctttaaatttagtgacttaaaaatacgtatctaatatcttacagttctgtaggttagaagtctaacacagatatcactgggctgaaactcaagtgtcagcaaggctgtgctcttttctagaagctttatgtgagaatccatttccttctcttttccagcttctagaggccacccacatgccttgactcattaactccttccgtcttcaaagccagcaacatcacatctttctgaatcctcttccctcgacatatctctttctgatcacagccaggaaagtttctccatttttaagtgttcatttgatcatactgggctcatgaagacattctagggtaatctcattttaaagtcaactgattagcaagtttaactgcatctgtaactttaatcttattttgccaaataaggtaacatttttacaagtcctaggattaggatgtggggcctctctacggagcattactccaactaccacaatcactaaccatttgcctctaaattgtggtccctgggctatttttcctctgaattaccagggtaaggttgatgagtgtggagattcaaaggccacatccaagaccttccgaatctaatttttttttttttttgagacggagttttgctcttgtcacctaggctagagtgcagtggtgtgagcttggctcacctccacctcctgggcttaagtgattctcctgtctcagcctctcgagtagcttggattacaggtgactgccaccatggcaggctaatatttgtatttttagtagagacgggggtgtcatcatgttggccaggctggtctttaactcctgacctcaggtgatctgcccatcttggcctcccaaagtgctgggattacaggtgtgagccaccacacctggctaagaatctgactctttagggatgggtctgggcatggtagaggtcaacaagttccccaggtattttctatgaacactcaagtctgagaacctcttcaaaacagtcctccaacaaggccattatcttccattgacaaattaagaagttgctgcatttgtgtttgctttgtttgaagttgtttctctaatcaattgatgaggttgcttgtaattagaacaaaagattccaattttagatagagtgtctaatagtgtatcaagtaactaaagtatgtactctgaagaagcgggcaccaattttagttcaaaaaaattccatctataatcactaaagaatctctgttatttgtgcttctttatacatcgatcatttatcaaaacctttttctggggtaaatcctgtgcttgctgttaagatacttaggtcaatttgtagcctgttaagtaaagggctcaaactttactaaatgaacccacatggcattggtctgagtctttgagactctaatctaaaaagagttctgttggtttctttccttgatctagtgtcagtccatttagaacattaaggggtactccactcctagaaatgaagtgtcctgtgtgcccagtcccccctgactggtttccctgacagtaactgaaatactaggacattagactaagggcacaaggtggacacacaatactgcatctccagcctgtggctcccccacactctcaaggctaaagtttacttcttgcccattcatgactactgtgtatggaagagggatacaaaaaaaaaaggcacaaaaaatctaacacatggacatatgagggggaacaacagacactggggcctgtcaggatggggtaggtcgtgggggaaggaagagcatcaggaacaatagctaatggatgttgggcttaatacctagatgatgggctgatctgtgcaccaaaccaccatggcacccatttagctaggtaactaacctgaacatcccggacatgtacccctgaacttaaaataaaagttgaagaaaaaaaaacaatctaactgttctggctctttacatatattacttcatttagtcttcacaattctggaaagtgaacttgactatgtaaatttacccatggaaaaacaggggatcagagaagcaatcccttgcccatcaatggcgcttaaaagtggcccatctgggattcagttaaaaatgtctctccttctcttggtggtgggatgtgctctggaaagtgcctgaagtctgtcagtcattcaagctctactctaactaggtttgtgaaaaacagaagtagagcttacacccattgaccagagtattgggaagggtaagatgctttattgggatatctctattgaggggatataattctttacttcccttttataacaaagaactggcttaatcagaaaacagtgtgaaattctgcatgcttatgcaactctcagcacttcgggatatgcacagtcaaggaattcaatggtaaaaatataggtgggtgacagaccatcaattaattaatcaattgaaataattttcaaaataaaatatggagtatctaccatttgccaagcactgagctcagagtctagggttgagtggttgcctcagtctgatttgcaatgctataaaagaatacccaaaagtaggtaatttataaagaaaagaggtatatttggctcacaattctacaggctgtacaaaaagcatggcaccagcatctgcttctggtaggggactcaagaagcttccaatcatggtgaaagggcaagggagccagtttgtcataaggaaagacaggaaggaagaagacaggggaggggtgccaggctcttttaaacaaccagctctcttgtgaactaatgttgtaggaactcattagcatggggagggcaccaagccattcatgagggatctgccccatgaccccaaaaccttccactatgccttaccccaaacattggggattcaatctcagcatgagatttggagggaataaatatccaaattatatcagtgatcctcaaacaattatttgtttgagctatatgacgttgccaatatttgaccacctcacctatagaaatggcatttcatatagttcaacctgtaattacacaataaactatattaaaattgtgattagagctatgaacactctaaaacaagaggaaagaggccgggcatggtggcttacgcctataattccggcactttgggaggccaaggtgggtggatcacctgaggtcaggagttcaagaccagcctgactgatatagtggaaccccatctctactaaaatttaaaaaaaaaaaaaagcctggcatgtggtggcaggtgcctgtaatctcagctacttgggaggctgagacaggagaattgcttgaacccaggaggcagaggttgcattgagccaagatcatgccattgcagtccaacctaagaaacaaaagcgaaactctgtcaaaaaaaaacaaacaaaaaaaaaacaaacaaaaaaacaaaacaaacaagaaagaaagaaagaaagaaaaaactgacagagaagctgtttgtctggagcacaagacatgatagaggttggctcaagatgcatccatagcagagggcagggagatcaggcaggatctggcagaccaaggtaaagattttggatttaatcctgacataaagctgttaaagaaaatttccccaacattttgttatattttcaaaacatagaaaaaagttaaaagagttacacaatgaactcccaaatactcactctacctggattttacaactaacattttgctattatctgtcaagtcttccatctgtccatctatccacttatcttattttttgatccattttatagtaagtggcagtcataagtacattttaccccaaactctgcagcatgcgtgtcattaactatgtaatgttagtgacattacatagttaaagaacttaaagttccatatttgtacagtttgttaaggaacatgtgcatgacagaaagtcacaaattttaggtgtcttattcaatgagcattaaaagattttttttaaccagaggtgtaacttggctccagcttttgggtaattaatgtctggggatcatggggagatgggattgatgaaagaaatcagttgaggggctataaaactagtttagagggagaagatggtaagaaaatccagtggtggccattgggacagaaagaagaggatggatttaaaagatgttttagaggtaaaacagacagaccttgatgatgaatttgatttgggttgatgaggaacaggcagggtcaggtcgacttttggtttctgggtggatagtctgagatgagccagactttggtaatgggattgagaggagagtcatgagtgcaagtttggacatggaccctcaggtgcagactttagttagttagaaaacaactaaggccgggcagggtggctcatgcctgtaatcccagcactttgggaagccgaggtgagcagatcacttgagcccaggagttggagaccagcctgggcaacacagcgaaaccccatctctacaaaaaatacaaaaattagctgggcgtggtggcatgcacctgtagtcccagctactcaggaagctgaggtgggaggatcacctgatcccaggaatttgaggcttcagtgagccatgatgacgccatcacactccagcctaggcaagagagtgaaaccctgtctcaaaagaagaaagaaagaaagaaaaaaaaaaaaagaaacaaagaaaagaaaataactaacactgaactgcatgtggagttccccttgcccctcccatccttcatccttctctggattccacccttagttagcaaccaacttttccatatgcacacctaggggaccagaatacagagtgctgactcaccgtctgaggtcactaagcagctattttgggaacatctggaggctttgtctttccattttcagaaggaaaactgtaaacccaagaagccttagtggaggccagggcgcacatgctgggcaaactggctagagtgctcctgggcttcaggcaggtcctgaaatgtcaagcccactcctttctgtcacctagagcatccccaggggaatgtccagttaccggactctcacactcttcccattaggtcatctctaatgccaaaggggtgcctgacaaaaagacctcattggctactaggtgcttccaacttagccatcgttggaggattgtgggtttgaactggcggtccagacagaaactggctgacacccacagggaatgcattgttgccccatctcaggctttgagttccttgaggacatggatcactcatctccataccccacaaatgggcaggaaatgattgaggaaggaagaatgaagagaagatatcccactcatcagacatttgttatattccaggcaccaaactgagcacaggaacaaaaagatgcattagacacagaccttacctagttgcagagacaggaatgggagataagcatgaaaagggtatgcaaaacgcagaaagacaacaaacatctacaagatcaggaataaggttcccaggacaggtgacatttgaggtgggttttgacagaggacctgatagaactcaggcaaagggaggaatagaaactgcaacacagtggggtggaaaagaaagaggctgtgggttcacatcccagctctgcctttttatgttgggcaaatgaggtctttcgaaggaggttgctaactccagtctcataccggctgctgtaagcatgcagtaagataatatatgctctgggcagatcataataaaagctcatctttattgagttcttactggcttgtaccagaaactttctataattttctcatttattgcttacaacaccaagtatttgtcatatggggtatgatcttgtaaattaattcatttttcatgggaggaaactgagttaaggagatgagctaatttggtagaaatagtactttagccaggcaggatgatggcagaaacaaaatgattaaaggttatgttatagccccttcttgtcctcagagactcttcattgtttgtggatcttggacctttatgagaatcaatttctcccccagacaaacaaacaaaaaaatgcttattcattttgtttgtaaactcagggagtttttggaacccccaaagtctgttcacagactccacgtttataacccctctgacaccaaaccacccggccacactgtgcagaactcacttactccatgtggccaaggtgggaggagaaaaaaaaccagaagagcggctcagggaagatgcctccaccttgcccagactagtggcagttggaggctgccatagggggaaagcaggcactgagcaccctgccctggggaggaggaggaggatgcatcaatgacacaacagtcagggtaaggtgggatggccccgagccagagcggcacctcctaggcaccccgagcatcgctctgagtcagggtggcagtcactgaggccatcgttgcctgccaggaaagcacaagggagaagcccagcaggagccagagctgtctgcacatggcagcaacatcagagctcagcctgggctgtggggtggggtgacattggcacagctcagccatgtgtctgcaacccagaccagccctggcctggggaagcttggggagggcctggcagaactcccttccaagggaggaggttgcacaggacaggatcccaagaggcctgagatggggatgaagctgggccagggtgaggccacttccccacagccctggaaatgggaggtcccgggctaccttgggaggatgaattagcccacatcctgctagcggttgagggggttacattattctaccttctaatctagaaacgtttatagaggttatttttttcttgcaggggtttcaagtactcatgagtttattttttcaactttttaactttgaaatgaatatagactcatttcaacttgcaataatagcacatggagtcccttgaaccctttgcctagctccctccaatgatgacatcttatcattgtaatacaatataaaaaccagaagactgacatctgtaaaacactgttagctaggttacactccttatttagttatcaaatgtgtgtgaagctttaaataaatggcttgcatttacaggacctcatcttagtgctgttccacctcccaggcccatgaagtaaggctgatgttagtttgattgggaggcagagcaagagacagagaggggtcaggagagaagaatggagacacaagcagcagtcttttctgaggtcgaaattatggccatgccatgtggctcagacacagtcagacttgacctgacccctctgtgaaccatcgcagcacaggacacaggccaggtggcactcttggcacatacctgggagcttccgtgcctactttccttgcttattctatgcagtgggttgaatggtgcccctcaaaagacatgtccatgtcctaacccctagaacctatgaatgtgaccttacttagaaaaggggtctttgtagacgtaattgagttaaggatcttgaaatgagaacatcgtggattatccacatgagccttaaatacattgataagtgtccttataggagacatccagaggagagacacagacagaagaaaaggccacgtgaagacagaggcagattggagtgctgcagccacaagtatgtggacaccaccagtagctggaagaagaaagcaggaatcctctcctagaacttccagggagagtagggccgagctcacaccacaatttcaggcttctttcctccagaactatcggagaataaaattctgctgttttaagccaagtttgtggtcatttgttatggcagccctaggaaaccaacatattctataatgcaaacggcccctctgcacagcccttgcctttcatagagcaggtagacagacattactggtttgtaaccactaacaaatggtcctcaggaatcaaggcagaacagttgatgccagttcaccaacaaggaaagctgggcacagagcactctgctgacctgcccaaggatgcaaagcttaggtggttgagcagtgactcaaacccatcttttgcttatgcccaagcctcattaagatccttgctaagatcatccagggccattctgagggacagttggttgcctgttgtagcatgtttttgttctagagttcaatctctttatttttaaaaattgccaactggcaaatgtcagcatctcaaagaagggcattgaccaggtacttggttatcttttcatgtgcccctgcctccatctgagacaaggggtaaagggaatcaccgagaaggtgggcagggccaccccccacacagcaagccctagggaaggaaggtggagtctggatccccacgaatgtccagtggaacatccactgccttctgctgcagctgtgggcagctgctgttccctggcaggccccaaaagggccccctgaaagccaagttctcagccaaccagtcccctctgtgcttctgaagactaacgcaggtcaagttatccccacagtcctaacctggtctgccagagcatcttccccctacacactttcccttggagtccagtactttatttttatttttatttttgaaaaggtattacatatacatgggaggaaaaaaaaatcaaaacatcatctccctcccactcagaacatgagttcctgaattctccttcccagaaataacaactattaccagttacttgggtttccttccaggcagaagcatgtagagctaaacatgtccttcttttatacaaatgagaggaccctgtgtgcatcattctgcgccttttcccatttgatatagcttgaagatttcccccaaacagtacacattcttgataacagcttccacagtattgccttgcataaataaactgaaatttctttcatctgccgcctgtaaagcaacacttagggtgtttctaatatgttctcaccataagcagtgctgtgatgcatagcttgtacactcatatttgtatttttagtagagacaggtatgtctctacttcacacatatgtaaaagtgtctccataagatcaattcctgaaagaaaatttgttgcctcaatggatacatgcattttaaaatttaatggaaactgtaaaattgccctccaaatggcttgtaggaatttatcgagccagccagcagtcagtatctgtttccttgcaattgtaccctaatgatgtgtgatcaaatcttttgtctttgcaaatcagctaagtagcaataaacatatgagtgctatgaaggatctggtgatgtgataggaatgtgtacatatgagtatgtatgtagaaatcattgagctgcacacttagaattagagtacctaaggaactttatgcatgctgtacctcaataaaaagaaaaatgaggccggatgcagtggctcacgcctgtaataccagcgtttgggaggccgaggtgggtggatcacctgaggtcaggagttcgagaccagcctggccaacatggtgaaaccctgtctctacaaaaaatgcaaaaattagctgggcctggtggcaggcacctttaatgccagctacttgggaggctgaggcagggagaatttcttgaacctgggaggcagaggttgcaatgagccacgattgcgccattgcactccagcctgggcaacagagcgagagactgttacaaaaaaaaaaaaagaaacaatatgaagaaaacaggatgctgagattcaagaataagagggtcccttccttacactgggcggtcttgaagtgcctcacttgcaaccttaggagcaatgagactcccacaaaggagtatctggaacccatgtgaaagaaggtttcagatacaaggaagagcactgacaatggacagggaaggaggcagacttgcttgaggaagtgaaaacagcaagctagggggactggtcccagatgaggctggaaaggttatcagagtccagatcaaacagagcctcttaggcaagaagttggggttattttctcatagaaatgggaaaccattgaaaggatttaagcacatgagtgacaggatccagccagttttgttgttttgttttttaatcacacagctgcctggagagtggattttaggagggaaagaatggaagagcagagacaaattagaagtctgctgtgtttttttaagctgagagatgatagtggcttggatcaggatgatgataaaaataggcagaggtggaaagattatgtatatatttaggaggaatgatctatgagacatctatcctgatcaagagacggtcagctttctggctgggcctagtgggtgggtcatggtgccattgtaccaaaagtgaagaaggcttaggtaggtttagattgaggtcatagggagaaaaatcaaaagtctggctttaatcatattaagttgtagaggtctaagaggcaagagacatcaaaatggaatcacccagaggagagtaattggtgggctgtgaaatgaaatgtctgtgtttacgtgcacttgcacagagacccaaactaccatcacccctgctttaggccgaaatttcacagaattgtgggcaatgtctgtctatagccatgagatcagaacaactctgtttcatggggatagtatttttctccacagtttgactctaggctcttcaagagcagagactgaatgttaaatctcctaaaccctcaggaccatagcatatgctccccaaacaggtaagtggctgagttgagggctcatcacagatttagctcatgggatctcaaatgaaagcagttacctgagctcagatcagtatccactaggagaagcatgggcctggccgttggcaagcggacagaagaaagcccaattccccaacccactggattcaaaagaccccacgggcattgcttccagcatccaaatgagcaaatccagaagtcattgttaatggtgctgggcctggtgccacctttgtcaaatggagactgcgaaaggttcaggaaatcccacagaacgcctaatccctcttttttgggggaaaaactgctactatcaacccatctgtcccatagcaaatgtgccatcaaaaaagccaataagactcccaaacttggcttattttatctgtccccaaaactagccattacctctgtcccacagtctccaagtttagtccttccaagctgtcctctgcagggccgctaacatgcaaatcttaacatcctgcctcccttcttaaaactccttgatggttcctgttgtctttaaggtagagcccaaaccagtcacacatatcttttacgatctggcctctaacaacttttccactcatacaccctgacttctagactaatacaccttctctctgttccccgagcatgctacaacctcatttctcaattctttgcttgaaagagctagttaatatttaaaagaaaataatatggggagatgctaagttcttggggaacacagattaaaatgggataatcttttccagttataaattggtaaaaattgttgaagatttaaaatactcagtggttagagagggggaagaagctgttttttttgttattttttatgttttcgagatggagtcttgctctgtcacccaggctggaatgcaatagtgtgatctcagctcactgcaatctccacctcccggattcaagtgattctcctgcctcagcttcctgagtagctgggattataggcacacaccaccaggcctggctaatttttgtattattagtagagacagggtttcaccacgttgatcaggctggtctcgaactcttgacctcgtgatccacccacctcaggcctcccaaaatgctgggattacaggcgtgagccaccaaatctggccaaagccgtttattaatctgttggtaaacacataagttatgtcacatttaaagtcctgcacacatttaaaaggcagatgtgctttcaccccagccaccaaacttccagaattcttgtccatcagactacttggacaaatatatacataaaacatgtttactccagccttatttgtcatagcaaaaataggagacaatttaaaggctccaaaaaacagagcagctaagtcacttatggcacatcctaagtggtgaattctaagaagttgttaaaaagaatgaggtgaagtcatatgaaatgatttggagggatgtgtatgttattttgttaaggctgaaaaaatagctgtaaaatcagattatatgatccagtttttggcaaaaaaaaaaaaaaaaaaaaaaaaaaaaaaacaagaaaagaatgaagagagaaatctagtatgcacatcatttctctcgtggcagttcccctgggcagtgggagtggggaatgatgagcaaataggaaagactttcatattttactttgtacattgctatataattaacatattttcttcacaaacatgcactccttttgaaattaaaagaagatatatataataaataataattaataaaaatttttaaagagccacaggacaatgagttagcaagggcaattgctgctgatagttgaagaagaatcaagcctcgaagaacatggaagaatgttccccaagatctgaaaggaggtggtttaggaggtagaagtaagaagagggaggccatttgcacatagaccccaaattcaaagcaggcttcagagcagacacttccagggccttatttgtgcaaagtggcagctgggagaccatgttataagaactgactgagatcagaaggtgaacagcatgtgagcccctgtgaggatcactcaggaccgctgatctcctaggaccagttgtctggccattgctgagagccatcagctctgtacctggcgccctgctggggccaacccttgtctctgttcacatgacctggtgggagcatccaccagaaacaaatgtaagacgaatatctcaagagagaaatgattctaaaggaagagaggctagagctagttcagacctcagctagtatgctgtctggacctcatatatcctttgtcctgccctcagttctcatgcctgagtcctgagccaagggggtgtgtgaagaattagaatgaatggggtgctggtcacattctttgtcttgatctgggtgctggtcgcataggtatattcagtttgagaaaattcaacaacagctgtacacgtaggatgtgtgcacatatgcatactatagtcaataaaaattattaataaaattaaatgtccctcaatctccactgtatcatttttcttaaaaagatatagcagataaggagggagggttctttggaccttaggagagcaaaatgagaggactcttttgtttacttgggcatctcaggggtcatagccttcctcccagcatgagtggagcccacagtgatggtggtgcccatgagctctattgtaaacacctagacagggttacggatgtagccatagctagagatacagatttatgcacctgggaattttactcatatgtttgatgttaacagaaaaattcctgaaaggacgcaaactaaactaaggacagtggttacctgggtgagtcattcctactttttttttttttttttgagacagagtcttgctctgtcacccaggctggagtgcaatggtgcaatctcagctcactgcaacctccgcctcccaggttcatgccattctccttcctcagcctccggagtagctgggattataggcgcctgccaccatgccctgctaatttttgtatttttagtaaagacagggtttcaccatgttggtcaggctggtcttgaactcttgacctcaagcaatccaccctcctcagcctcccaaggtgttgggattacaggcgtgagccaccacgcccggcctcgttcttactttttgtatcatttatttcttcattatttgattattcctacaaaaaatgtatttttaattacaacttattaaggtcttttctcctcttgcttgttgacaaaactttagacatccttgaaggtgcaatcttttccccatgacactttctctgacttctttgtacaggttttctcaaagttttgtcctcccaccctgactacttgtcctagaatcacctggggagatagttgaatttgtagatttatgaccctcttcccagactggctgaagtataatatctggagctcatgaatctacattttaaggcaattttgttgctcattgtagttgatcatctttgggttagatgacgaattcctttcttttctaggcattcagacctccttaacatctgcattctgtggcccagggtttattgatcccaggactgtcttctccatgagactgcagcccctcaagggcagtgactatatccaattcaactaactttcctcagggtttgacataggacccatgacaagagatgttcaataaatatgtgctgaatgaatgaatgaatgaatgaatcttcatcatcacacaatcactggggtcccaaggatgagacttgcatggtgggccagtgcagatacagagctgggcttggttcaggtacatttttgccactctgaggaactccagcttgtgatcccaggctatccttagtagagaggagccaggattggtgagataatagggaaacttcaaaagccagtgaaaccagccagaggagccacccagtaacccagattatgggattcagtttctatacattaggctatctcaccattaacattaaaagagctgtggcataaatcacaagcagcatggttccaaagattaaggacccctcttaccagcaaattcaaggtcccttaagagtatagaacagtaatctcaagctcgcactgcaaagccagtgacctgggttcaattccttattcaacttgttaactatgttttgggcttgtttcccctatgattctcagttgtcccatctataagctgagaaaaatactattgcttaactccaagagttgttgcatcaggttagatcatccatgcaacaaatattccttacactcctactgtgtacccatgcccggtactgttccaagtgccagggagttaacagtaaagaaagcaagcacaaaaccctgtcttgagggttaattcatgtaaagcagagtccgtagcacagagtcattgcttcaggtggtcaaaggagactctttatatccagacctgatggaccttaaagagcaatctctaagctggctgtcagttcctgcatctagaaattaagacacgcaaggaaggtagcaaaagtcatccccagatcctgtgcaatggtcaaagaggtatagtaaatggctaataaatagaagctgtgaaaattgcaactgtaatacccaacttgccctgggggagcacagaggcagaggcagtgcctcttagggccctgaagcccagacaggagctgtgtaaacaaagcgcttcaggaggaaaggatgccaaaatgtgtccccagccacagagtggctcagcagactcccccggctccaattcttggaaataagtagctccttttttccagaagaaaataaacttaaacaggaaagtgcttcatgattcagtgggttactcggggccctggaagtgtgagtgtgcctgaagacgtcggcagtggtttacggagcaccccagcattggggaagaagcccagtttcctgaaagtgagcatggcctgagtctgtgtctgtttatgcccatgtccctggtacagtgcatgctaacacgtgcctctgtacatttgtatagtgggtgcacatgtgtccaggtgtgtgtgtgagtgtgtgtgctcccatgcaggttggtgggaatatgtgcctgtatgtggctttgcctctgctcctgaggacctgggtttataatttccacacacatttctctgtgtgtgtgtgtgtgtgtgtgtgctgtatgcacctgtatttgcttgtgtctatgtctgtgtgcttggataactgcaggcatgcttttgtgatgagcagaagaggagagagaaagcaaagacagtgaggaaaagacctgagccaggagaggatggggttcaaagcctgcggagaagtgtggagtaggtgctgagtcctcttgagagatttctgtcagggatgtggtgaggaaacagacccagagtgccccaccacagcctccaggaatgggttctgggttctctctgatctggtggctgctctgatgtcagggtataaggtggctctgtgggcatacaacagcccagcaagatctccaaggggctcctccacagccccacccaggggatctggcccatcaagtggcacacattaagacttttagtaaaggggaatcatgagcccccactgtcagccccggactgtgggaattatgactttccaacaggaggggaatgaaggctgctcccagcttctgggcactgctaggagatcctgggaaagaataacctgtgagtccagcccacaccctgggccttcactgtccctcaccagccggagaagctccgtggctgacacggcggatcgctaatatcccctactcaccccaggagagctgggcccaggcttcacagaagagaatgagttattcacatagggaaatgacaccaccagaggtgctgccatcagtggggtgcctcttgggaacttaggcattaagctaaagacagtgacagggtcagcgctagtggggcaaggaccagtgaggtgaaaaagaacagtttcctaaagaatgtgcagacatttcaggactctcgcctctaggaaaacagagagcttccacgttttgggaaattttcatcaaagaatattttctttctatctggtagtgcaattaccccgggcttgtcccccaagctgagagggcctggcctcgcagtttacaaagacaatcgccctggacaccagattccgcagtcctgggggctataagtagcttgtgcagtggcctccacttcctcatgtcagttttctctgagattttcctgatcctctagctgaccacacccactccaaccaagcacacagagcttccagagaagtctgccctgtcttcagttcccaagctcaggcatgtgcaaatgaggcccactcctaagcaaatggctgtcccaccccattctgggtctttcttatgggattcaccctcagtgtctagtcttagtggtaaaggatagagtagaggctcaaatttctagctgggattgtaaaaaactgcctacctgcctatccacaaaaagacacattcaacatgtaagaggtgaggaccaagactctgtcttctccagaaacactctcagacctgctagtgagaagccagctgggacaggctgcactgatccctctccctgacacctcagtcctatcagcaatcctccgtcccatcctcaaccaaggtaccacttttttcctgaatggcaaattccattttagaaccctgggaagtcctacatgtgtctgcctaggactcaaagctcaaatagaattggaactcaagaccggctataaatggtccagggtttccattccctctgcatttgaacccttctagagaacacctttagagagagctgaagctagggacatagtcattatactctcactgaataccaattgccgtcatcaggaaaagagacagagagaccgctgtgccctggcactgagaccagagaagggtagtgagcatgaattatgtattacacaagcaatagagataagagtggaatggggggaaatcataaccctattaataatggaagtgcagtttgtaaactctccaccaggaataatttgcattgcaatataaacagggagtagaacacagagcagctggcaatggcgtttcagtaaaatgtaaaagccaccatttcgaacattaaaagtcatgattaaattataagaatttgttcagcagcgtgtacaaggagagggcacgcgctccgactccatctgagcacagggtcagcccttcctccacatgtcttctaggagcatgaaccaaggacttgcttgggtccttgagaccttgccaattcctatattattattactagtatttgttgttgttgagtgcctgctatgtgcaccactgtaagcgtgttgtgtgcaataacagttaatttttgaagcaacactatgagggaggtcctataacatctccattttataaatgaaaaaaacagaggctaaatggtttgccttaggctgcaaaattgctaagctggaggtgttgcggtgcaaacccggacagtctgagctcccagcccaccctcctcaacactatgccctggtatctcttcgggagctgctcaggtgtccctttaggcacctctgaaacggtgctggtgggatggaaaattggaaccaaccttttaaaaaatgacttggtagtatattaggaacttgatcaacctgtgaccaagttgttcttcatttctaggagtctcctgaaaagaacttaaaagcattatgatctctgatagctactgaggtataataattattagatattgatgtataaaagctctgggtacaaacatgggttttattaccacattatcatgtgaaaaaattagaaataaccaaaatgtctgatattcattgaattgttaaacaataataggctgggcgcgatggctcacgcctgtaatcccagcactttgggaggtcgaggcgggcagatcacgaggtcaggagattgagaccatcttggctaacatggtgaaaccccatctctactaaaaaataccaaaaattagctgggtgcggtggcgggcgcctgtagtcccagctactcgggaggcggaggcaggagaatggcgtgaacccgggaggcggagcttgcagtgagccgagatggcgccactgcactccagcctgggcaacagagcgagattccatctcaaaaaaaaaaacaaaacaaaaaaacccaataataatgcataaatattatgcatccaaaaggggaattgttgataaagaacttacaataacaagaaatgtgcttgttaagttaaacaagtacgatataaaaggatagactctctatgagctccactgagtaaaacaatatatagagaactgtgggcatgtagctacaaggttactaatgttcctctgtgtgtcaaaaagtatacatgtttccttttctattttctgcattttccaagcatatattaattacttttacaatcttaaaaattatatagatagatatagatatgttgatacagacatattgattgattcattctgttacttagtatatgtaaatttgaaggtgccctcaccatctcaattgtaaacaattatagacaccaaacagaatgagaacagccctctttgtccccagcttgtcatccctgtcctcaaagtcctgtaggtcccactatccaaggagttcccctcactctctattgagtgcctccctcactaagccatcggctcagaactgcctggagcagaagactgggactggaacactgtcctccacacaacataaagagtgccccatgtgtcacgcacttttctctatggtttctataagcatcagacataggggaaagcacctccatctatgtctgtggatctagaacccgacaaccccatgcttgctcccaggaaaatcaggcgaagctgggagtgcctgccctcatggtgaattcgataaggcactggtctatgagacactcctggctctatactgaccacctggctgtgtgatctcaggtaagtcacctgagctgcagctgacccttccataaaatgggaatgtttgacttgagcatgcgaaggctcttttcctgccatgagagtgtacacacataaggtcacatgagtttgagacaaatctaaatgggaactatttcaaggctgttgtcgagcattccagtgcatggtaacataaaggcccagctgccttgccagttcagaggctggcagcagagaaagtgagggcagtggagttagaacaaggcggcatgaacatgtggctggagtgagctttgggcagggtggccgggctcctggcctcccttattggccagagtgttgtcatctggaatacaggcagatggactttgtcacaaacagatgatatcccatccaatgacctgtaagagtcttaatgctgaacaccctggcaatgggcagaccatggctcctcctggaggatgatggaagcagggaagataactggattctccaagatgggagtagcattcaagaagtgggatgtcacaagactggggacctagaagccccaaaactgccaggaggctgagaggctctgagcccaggttgggaagggagcagacagcaaactatactccccagtgttctcagcacattattgacattccagagaggagaggcagagaattaatttcatgatgacttcctcccccaatacccatccctctcccctgcccacacaatccccagctaagtccaaatgagggcctgagacttgcaggaagacaaatgatcccaatttaaaaaatgctccagaggcctccatattccattccttcatttgttcctccccagtgtcccacaagaggctgcagatcctaatcctgggcacagtggcagtggcatgcagttggtgctcagtaaatgcctgttggctctgaaccaaatatcttcaaactgccctgtgagacatcactttcccagaggggaggacgagcatttagcattaacttggttcttattctgcaaagcgatcccagtttccactgcctctgcctgtgaaagtctccctactgccagtgtcccaggggctcacagtggcaggaggcctgggggctttctcacagctgcctttaacatttccttctggttatgccccgctgctctggtgactgatgctatttgtcagtcaccacccaggggagtcatggagaaagattgcccaggtgcctgtcacaatccagatacagccataggtgctgacaccttgtcactgtgtcaccccgacctggtcttattggcctttacatgttgcttcccaaagagacatcaggagatgtcagaggctaagtgggggcggggtggtccctggatcccagactcacctccctatatctgcagcagaaaggtagtcacagaaatgcaggaaggaaagaacacagcctttgtggagcctggaaaattctgggctcttggggcaatgagggaaactgaggaaggagaaaatgtcaggaagcagggtctgcccaagatggggcacagaatcacacagaattcgcctttcaagatctgattataagaaaataatcaagcacagggactacgacttatgtccaaagatgggcattttactgccatgcctaagagtaggaaaattagaaatgcctctgcttggccgggcgcagtggctcacgcctgtaatcccagcactttgggaggccgaggcgggcggatcacaaggtcaggagatcgagatcatcctggctaacatggtgaaaccccgtatctactaaaaaacagaaaaaaattagccaggcgtggtggcgggcgcctgtagtcccagctactcgggaggctgaggcaggagaatggcgtgaaccctggaggcggagcttgcagtgagccgagatcgcgccactgcactccagcctgggcgacagagtgagactccgtctcaaaaaaaaaaaaaaaatagaaagaaatgcctctgtttactgtgctaccctgggcaagacacttcactatctaagcctcagttgcatcagctgcgaaatgggaaaaacagtaatactttatgaatttgctgcaaagattaaatgagataatgcacagaaagtgctttgcatagtacttgccatagagtaaattttcaattttagtaaatagcatttagtaaatagccagtagcaagtagccgttactaaaattgcatccaaaaataatttatcagttacacaaatggtgacatgccaaaaaatagtgtgaaatactaagcaattgaaagcaggtttccttccaaagagatttacagtgaaggggaccaagcttatggtataatttataataatatgtatctatgtttttcctataaaatgtgcatatttatagtgaggagtgaacttaattttttattggaactttattggaacttttttttaatctatgtccaaatttcactagtggggacaggaaattcttggctgaatataggaggggtccaggaagccagatggaattaaggaggctgtttcccctaagcagatgaaatcctgctctgaaaaatatttcctggttatcccacactgatttagtctgttcatgtgcatgtgtatgtaggtggttgtgattgtgtgtttgtgtgtatgttgtgtggatgtgtgcatttgtgagtttctgtgtggttgggtatatatgcatgtgtgtttgtatgtgtgtctgtttgtgtacgtgtgtgtgtctgtgttcatgtgtgtgtttgcgtatgtgtcccttgctgcatatgcattccctagagcagtgtttccagattgttcaaaatgcagattctaaacatagacacctgaccagagcagggagtatcctgaactctgaatatgtgtcagttttttagggattcatatgcacagcatatgaagagtttggtaactctaaagacaggtatcttaccctgttcacttcaaatcaccagtgcctggcataggacctagtatataagaggtccaacaaatggttattgaatgaatgaatcagtcaaccaatcaatcagttaaccaattcatatcttcccaactttgaggaaaatacacatatcctgaactgtactagaatgtgagttccctaaggatgggaaccatgaacatagattttcaataaacttggtgaattaattagttttccctaatatcgatgtaaaggaaggctcttcttttcctagaaagactgtctttcttaacagagctcatggtcacaggggaaacacagaggagcagaaaagactcttaacagtgtccactcatgccagcacatggtctgtctgtaggagtatgggtacaaatgaaaagtggtgacaaatattactcttacagcaaaagactgaataagaacaaaactagaaattgtagctgcagccacctctcaaatctatatgatttttcagagctatcaagtttctttatcccatttgatccaagacaatggagtgagtcccactttgacagataaaaagataaagtgactcaaccaagtttcttcagctcctcaggggtatcaccaggccaagaatcctggttgtcaagtcgagcttcattttcaggattctttgttagtataatgatgaagactgtaattttcctttgtttcgcctcctcagctcaactataagcagatcccgacttcaggaagcatccagctaaatgagttggatgtgtccctccaaaggtttaagcaatgaattattatttcacaggtgcctctgattcaccagctctgaatagctggactggtttggcttgtttacacgcaaatgcaaaagccattagggagccccagttccaacactgcagattttgttctaagtaccaacatcccaaaatgctctccattacttatctggaatttcaaaatcatgcaacaaatgtaagttacagacaagattttttaaaaaataataacagcaatgccagagaggaaaacagaaaaaaagaaagacaatatttttcaaatattttcccaactgtcattttaataatggcctatcaacaaagtatgctaatttccctccacagatacctgcgaatgcaaatgcaaaacaaataataattaatgtctctgtgtgaaaatcaagcaatttctattaattctgcatcagacatgagattatgcacattcaaaatcatgatctgttttcaacagcaacagtgacaattgtaaagaagaaatggtgaggggaggctctggagttaacagaatccacatagccatccttgatatgacctctcccagcttcccaacaaaatacagtcagctcttcatatccacagatgcaaccaaccacagacgaaaaatattcaaaaggaaaaaataaaaacaacaataaaaaataaaacacatttaaaagtacagtataacaactattatatttacataataccttacattaggtattataagtaatctacagatgatttaaagtatattaggggatgggcttatgttatatgcaaatactaatatgccattttatgtaagggacttcaatatccacagattttggtatctgtggggttcctgaaaccaattccccacagataccaagggacaactatatatacgaacactcttggaactaagaagagtaatcaaccaagtgtcaaattataagcaaaagttttactagctatagcataaaaggaaactgataaaaaataatattcttgatggtgagtactgacatctgaaccagagtatcaaggctggaaggcactgttgagccctagctcacaagcagagactccagatctttgctgattaaaaaagcagacaccctcctctctggtatgctccaagagcttcctaaacccatcctccctgaaactaccaagaatggtcttctttttttttttctttatttcaaaaaaaaaaaaaaaattggatacctattgacccgtcctctaagttccctcccctcacccctcaccctccatgccccaacaggccctggtgtgtgttgtttccttctgtgtccatggaaaaccaaacactgcatgttctcactcataagtgggagatgaacaggaatggttttctacttcagtttatagactatcatctgactgcaatgtcacatggagggaagtggaagagatccaagatgggatatgatgctggcattaggcaaagtcataaaaggaggcctggaagctatgcttcttagaggttgtgaggtttcagatattatttctaccaaagggtagagagaagactatctcagaatgtccagaaataaatgatctgtttcacactcaaagaatcagggaacaaaagatctcacaacagtccagcaaagtacattgtagtcaatgcatgaaggaaaatagaaacccatccacagctatgctgtccaacataacaggcactacttatatgtggctatttaaatttaaattaattaaaattaaatacaattaaagattcaattcctaagttcataatcacatttccaggactcagtagccacatgtagctagtggctagcatattggacaacatagatagggaatgtttccattgtcatagaaacttctattggatagctctgatctagagcctgaaaagcctgaaaacataaactccaagtgacagatatctttcacttattcatcctcccctactctatcccatgctcccagaaggcagacctctatggcatatggtaaaggacttcttgttctttttttttttccaactaacttttattttaagttcagggggtacatgtgcgggtttgttacatgagtaaattgcatgttgtgggggtttggcatacagataattttgtcatctaggtaatgagcatgatactcaataggtagtttttcagtcctctcccctctcaccctccaccttcaagtaggccccagggtctactgttcccttctttgtgtccatgtgtactcaatgtttagctcccacttataagtgagaacatgcagccaatactgtatatttggtattctgttcctgcattaatttgcctaggataacggcctctagctgcatccatgttgctgcaaaaggcatgattttgttcctttttatggcagtatagtattccatggtgtatgtgtaccacattttctttatccaaaacaccactgaagcacacctaggctgaaggaattcttgttctttggtctctggttgacttcagcgataggagggcactagaatgacactataggaccagagagtgaagtgaggcctttgttgctttggtttctgacttcctccctactggtcattgtgatttagatgtccctctgttaaaagctgtcactcttggcaggcagctttccatataactattctctgggctctggtaacatttccctcctcctcttgatccttcaggctgagggtaggtaaaaatgcctcacaagcgactcgacttggggcactgcatcatcccttttttgttttttgtttttttgtttttttgagacaagaagtttcatttttgttacccaagctagagtgcaatggcatgatctccgctcgctgcaacctccgcctcccgggttcgagcaattctcctgcctcagtatcccaagtagctgagattgcaggtgcccaccaccatgccagactaattttttgtatttttagtggaaatggggtttcaccatgttggtcagactggtctcaaactcctgacctcaggagatccacccaccttggcctcccaaagtgctgggaatacaggcatgagacactgcgcccggcctgtgttatccctttttagagctcctaaactcctcccacaccctgggaaatgatcccttaataaatcttttgtcaactacctactatgaggatgttatgtttcccctgagtgagtaccctgatgggtcagattctgctctaacttaagtctgaggaaatgactttatcaaaatctacagagaccgcagaatctatagtcccctggggcagaccatggatttagaaatatgtctttccatttaacaatgattaaacaaaggaaaatagcacaggagttagcaaatgtttttcacgaaagcccagagagtaatattttgggttttggaagctatacagtctctgttgtaattacactgcagtgtaaaagcatgtagccatagacaatatataaatgaatgagtgggtctgtgttctaataatttcatttacaaagacaaggaataggttggatttggtccatggactgtactttgcctaaagatgccaaaaaatgcatgcctctgaatttatttactataaaaagaagaaaatatatatatatatatatgtacgtgagtgtgtgagtatgtgtgtgtgtgtgcacgtgtgtgtgtagttctctataaactgcaagaatgtatggcttctaggaagagaaggagataaaaaatgaaacaaaatgcaaaagcaaaatgcaggctaaggtgaagaaaagtcttgctgagatatcaaagaaggcagagaaacaattaatacactcttagaattatagtttacattagaagcaataaagagcagaacttatactgcagaaaactaagtttcagagaaataataaatttgaaacatatcttttagaatctggagttgaaaataatgagcaaacagatggcatatatgaagaatagagaaaagtgatccaatttacaaaaagaaaatagtgttcctttaaaaagtctctaaaaaagtaatgacactgaaacaccaatcaaatctatattagaacattcttgaactgaaaataaaagatctaaaattgcaaaacaaaatggtatactctgcacaaatcataattgatttaaaaaaaaaaagaaacccacagcttgatagcaaggaaaaaataacttataagtatcccaggcagaaaacaaagcaaagcaaaaataataaaaaccacattgtttgcaaaagattaaaaagaaaaaaaatcagattgggttgacctcagaactctccttgatgaaaaattaaaaataaacataatggctcacaatgtggaaatggttaggtgtacttacagtacaaccagatgttagaatattatgcaactatcaaaaacaatatagtattaagacaaatataataacaaatatagtattaaaagaaaaacaatataagtatcttccaatctcattaaaagattggaaaatacttaggataaaatatttagaaagaaagttagacacaagaacatatataatatgcatgtatgtgtactaacacatctactgtatttctttctagccttttgtctacctgtatatgcaagtagaaaaatactgagtattatttgcacatcctgcaccactcaatagtttaattctcccaatatatctatgaaatagtaacaatatatcccacagcacacttaagaacactgagggttggagaggtcacgaacttgtccagatcatccatagttggtggcataaccaagattccaatcaaaatctaaaatgaatatgtttcccttatgctagcttaatgagggtggtggctgcgctctgtgggaggggaggagataggaaggatgaatctgggtcctgagagaggataaggccctgggtcttggtgctatcagcagtagttaggctggacagatgggaccagttttcctttacccagcatagctctgagatgtcccttcagaatgtcagcagtgacccatctccctctggccatgatctcacctctggggagcctggaagaaccaacagaattcaacagaaaccccagggctggctaacttgaaggatgactgatgttttaccaatttatcaaaatatgaatttaatgttgtaatctccttacatcactatgataattctctgtttatagttagaaaaaccttaggaggaatactactatctcctcttccagaagaacagatcaggagcaaagctacaaagattgtacacagttctgaaatatttacttcttctgaaggaacattttataaagtcaaatttctgtgctgggcttgctgatggacttaagtctttgggcagttttacagacaaagcagccaaaacgaaaaaagaaaaaaaagtaaaagaaaagataaaaagaggatacctttctccaaaaggtggtcagtagagaagggtgtatttgttcaggactttcaagttctttatgaagtgagagactttgctcatttgttaattgatgcattcattcacccgaaacatctttatgaagcatgagccgcagagttggactcacagaataagaagaagtatcaaaacattgctcctgtttccaggaacccacagtctggaaaggcatgggtgggggtgtttaaaaaggaaagagagtcacataacccattgtgtggtttagaaagcccattctgtgaaataagcaagtggtagaaccaacatatattgcaaaaccatttatttgaatacaaacaaaacacatccaaagtaatgctatataaatatgtaaacatataaagacatcaactaaatatgttatcacatttatgattctggttgcctttggggaaggaaaaagaattagaagaattagaatgcaggtgacttcccgtttatctttaaaaatgtctttcttaaaaagaaggttcaaaataaacacaacacaaaaaaaacacacattgtatgactgtatttttgtaaagttcacaaataggcaaactaatctatgctattggactcaggatagtggttacctgtgatcaggtagggtgggggaataacaagaaatgggcaaaaggagaggcgggtaatgttccttttctttttgtggtacagttatatgactgttcactttgtgaacattcaacagatgtacattaagatatatgtacttttccatatgggtgttatttcaataaagatagattagatagatagatagatagatagacgatagatgatagatagatagatagatagatagatagatagatagatgatagatagataatagaaagaatagaggaaaagcatctgttgatttggagtagcaaatatatggatattagctataatatctctgcacttttctatatttttaaatgttttttcctaattatgtaaataataaaaacatagaaaagacaactctagctgccctatagagaagttagagagtggagtaggcagaccagctaggaagttattgcaggagctcaagttagaaaagatgggactggagggccaggtacggtggctcacacctgtaatcccagcactttgggaggccaaggtgggcagatcacgaggtcaggagatcgagaccatcctggctaatacggtgaaaccccatctctactaaaaatacaaaaattagctggctgtggtggcgggcgcctgtaatcccaactactcaggaggctgagggaggaggatcgcttgaacccaggaggcggaggttgcaagtgagccgagattgcgccattgcactccagcctggcaacagagcaagactccatctcaaaaaaaaaaaaagcaggggagaagataatggtgaatttacaaggtctggtgaccatgggttatcccttcggttgctctgtggactttgagcaatccatctgtgtgattaaccccacacaccaaggtctcagtcacccttgaacatgggaagaacccctcatcatctgcagggtgagatgtgttttgccctgaaatccccttccccagtgcctccccttagcctgccctcctctgatcctgaacccccagccaaggactcccccagagccctttaattggcttaaacactagacaggagattccctggcaggggtaatccatgattgaactagggataatcagcatgattcatttgtctgattaaaagctctcactccccattatcacctacctgagaggaagccacacagggctctgacagcaggtaggcaaaggctcagggcctgacactgtggcggggtggggaggggggcagagtagaaagtgattgaatgacacagggcacaaagctcacagcagcacttgtccaaaaggaactatagaaacaaaggaatgggaaggccggtactcacaacatggaaaatatccacctggtggggctctgtgggaccatgcacatcccgcagaaatgcctgtgatttggggacgtttttcctttgatcctcatagataaagggtttctgcttccccgcctcagaaaggagcagtttgtgtctgagcacttgctattcctctcttcattccctcactccttccattctgtgagaggagaaatgattggtctgactggtgagtgaaaagagttttccattcactgcaccatatttgccagggcagagttgccattctgaatcatgaggtttcctctcaatctctctgtcctctattcttttggacattgctattctcagagggagcccactttttggcatcctctatgtggtcaggtcatgagggcagctacctgccttttgcagaccaaaagggcctgtgttctctttgcttcactttcttcgcatgcaacaggttgaagaaactcagccatcctagtactagaggcctggggagagaaaaagcaaacccccttttgccgaatgttccctgtaatagattgtattattgttcctattctttatgtcttcctgtacctttatcttctgcctgtgcctttggcatactccccaccaaaggaggggtatatttacctgcaggtcagttgacatagtctgggctttaatccatgctacaggttgggtccacctctgcctcacacatctctccgtctccacagatcagtgggccagttccatgcaggctcttcccatggaaatggtaggagagcagaagcttatgagtggagacatgagtttgttcataggatttgctttggccaaagtaatgtgggtagaagtaactatgtgaactgtgtgctggattcaagcctgggtattagaagacatcacatgtctccactcacaagcttctgctctgcttctgccatttccatgggaagagcccgcataaactggcccactgatctgtggagaaggagagatgtgtgaggcagaattggacccaacctgtagcatggattcaagtccagcctatgtcaactgacctgcaggtagataagtgagaataaacgctgcttcaggacactgggttttggtgtgattccttgtgcagcattattgtaacaagagctagctgatacaccccatcatccctggttctccaggtcagtaaagaaaactatcactctaggttataatgctaatattttgcccagtttggctgaatgctttgggtttttactttatcgatcaagccgatggagaaaagtttcaataagtgggaggagtagagcacaaagtctagggtaatcatatgtcccaatgggcctggatggccctaatttatacctgttatgccaatataattaataatagcacccttctgtccaaaagtacatcctggtttggatgattaaattatatcaccctagccaagcccaacaagatccagcctaaaccatgtcttccttacactaacaatgggcacccctttgtggtcagtagataccccagaattttttaaaaagccatgtcctggaaggcaggaggcctggacagcaattctcatggcagcaggtgaggtaaaaataatacttttcctaaatgcagtctatctgcacaagattttataaaagtgctatggggtattttctgagaaataaactccttaatatgacttcatggtaagagttctatttcctttattctcaggagtcctagggaagaaaaatatgccccctggcagtgttccataaaactaatgatgtgggggaatacgtgaataattgcctgaatcgccgggttacatatctgttaggaaatctcttggcaatataaagaaggggctcaggacagttaaattgaagtcaagtgaaataaactcctgctgcatcagctcgatgatcttgtgggtcaagggagctgtggcagccctctctgcactttgggaatgttgggcctccaagttttctgggttcagagcaacagggacataggatgaggagtagaaggaaggaataaacaggcatggaccagacattgcagggatgcaaagggaagttctggagccaagtcttcaaagctacagatcaaaaactcgggcaaggagcagtggctcatgcctgtaatctcagcgctttggaaggccaaggtagatggatcacttgaggccaggagttcaagaccaacctggccaacatggtgaaacctcatctctctgaaattcaaaaattagctgggtgtggtggtgggtgcctgtaatcctagctacttgggaggctgaggcatgaaaatcctttgaacccaggaggcagaggttgcaatgagccaagatcatgccactgcactccagcctgggtgacagagcaagactgtcaaaaaaaaagggagggagagagatagggagggaagaaggaaggaaggaaggaaggaaggaaggaaggaaggaaggaaggaaggaaggaaggaaggaaggaaggaaggaagaaaggatgaaggaaggaaggaaggagagaaggaaggaaggaaggaaggaaggaaggaaggaaggaaggaaggaaggaaggaaggaaggaaggaaggaaagattactggtgagtggtcagatagatggatggatgaatgaatgaattctaagtgtggggttattccttgtgcaatattgatattgtacttcataatattatacttccaaaattattagagtaaaaggaaatgattcaaaaagcaaggaaaggttcagtgtgctgaaaaatacagtaagcccaattcctttctcacccaccccactctcagccacggaaagaggactgatactacagcatcagagaccatccaagacaatacagttgtccctcagtatcctcaggggattggttccagaacaccctgtggaaaccaaaatctgcagatgctcaagtctctaatataaaatggtatagtatttgcatagaacctatgcacatcttcccatatactttaaatcctctctagattacttatacctaatacaaggtaaatgctatctaaatagttgttatactgtattgtttggagaataataagaaggaaaaatgtctacacatgtttagtacagatgcaaccatccttttttaaatttgttttcaatatttttgatccacagttggttgaatccacagatgtgaaacttatggatatagagagttttatgttttttgagagagagatggggtctcactatcaaaagcctggggttgcccaggctgctcttgaactgctgggctcaagcaattcttccacctcgcaatcccaaagtgctggaattacagacgtgtgccactgcacctggtccaactgtgttttaaattattcttccagggtaatatagaaatttggataaaattcttgaatttgaacaaagtagacaccagtttgcacaatgcaggacatcaatccatccatgccctttgtctccagatatctggtgtggatgtgcattcatgtcaacacaactttttaaattgcattttttcctccttctcactcatgtgtcttcagagtaaactgaagaattatttcagtggagccataaacctctcggtctcccaagacatacatatggactccatgtcaattttctctcccacactgcacctgaactatttcaaactatcttcccagttgaccaaaccagaaacctcagagtcgcccactactctgacctctctctaacccccaacccgttagtctttctctcataaatctctctggttcttccagcccacagcctgtccactctcatccaggtctccaccacatctcccctgggttgtaggagaagctcttagctgcctcttggcctgggctctctcctttaaatccatcctatacctagaaaccagagggatttttccaaaacagaaatttgacctccctggtcccctggcaacccatcaatggcttcatgctgtctttaaattaaatctgaaccccatgtgaggctctgcacaattcggcctctgcttgttcttccagcctcatctcaccactccctgcttctcacccgaggcctagcagcagcctccatttctctggctccttgttttctgtcactttcaatcattagacctcctcttctagttcctggaactcaattgctcactccatctcaatcctttttttacctaagcacgattctttcactccacaggttttgctgaagtatcctaccatattctgcaagagagtatctcaacatcctcctagcttaacacttaacaacatagtattatgttagcttgatcaactcactctcctccccttgtctgaaagatcaaaaaaggcagccccaggccaatcgtgtttgtgttcctagcacctaggccaattcctgacttaaagtaggtattagaaaaaactttttgaatgccagacaaatccatgaactgaggacaactctttgtttattcaacatatattaatggagggcctgatatgtgtcaggtatagttctcagcgtgtgggatacatcagtaaaaaacataaaatgcctaccctggtggtgcttacttttcagatggagggagacatttatttacatatttaacaaatatttatccggcagagaatcattgcacacacaaaaaagatggggtggcctggccagacatgtacatgacagatcagttctaaaatattttccttgtttttagtttctacttcaatgaaaaatttgtcgtcatcttagtgttaccgtcctggaaattctcaatgtcctctttgcctgctcaatgtttctctgtaacagtgttcatcatctaatataaagagcaacacaaacacatagtttgtgctcaatcaaagcttgtggaatacagaaacaaacaagaaactccaagagctcattcagtaaacttacaaacaagtaagaagatgagcttatgatcagcctgctcaaagcaaaagaaaagggaaggaaacaatttttctaagagcccttcagaaaagggagaaaagctttgcaaaactcagagaacccaggagcagtaactgatctttatgatccagtacagaagcctgagtaaccgcaggctgtctcaggttttaatacaaggttatttacatagttacctaattattatgtctcaatagagggaaggaaaaaaagcaagtgtttttctactccctatttgccttaaagatctaagggtaataaattgttagttttattcttaattggtacatgcttcttccaatttcttttctttaaaaaaatcaatacgtggtttgcgagacctttaatggagagtaaagaactgtgactagacttcttccttattattgagataatctgtcagcatttatcttttaaaggggcctcaggtaaggcagacatgattaagtttttgcagtagtaaatgctgggccatttctagagttaaaatgatatgaaaaatataactgcatcaggctatgcctgataaaagacagtgtctcttttgcaaaaatgtgggctgtgggtctggtctgctgaggcagggctcccaacatcttggaaatgttgtgcccaaccactgcccactgccctggccgagctcctgcccccactgagcttcgggaagtgactgcggctgttcccagcgagcctgaccagaggcagaggccactggtaaccttaaccccacgtgggcaggccctcgtcagagcctctccccaaccctaaaattaaccagtaagtttttggaaggggaggtggacagagaagtgcagggccctgtttgctctttggagcccaaaggaaacaggagcctgggagctgacaccctgggcctgaaaaattgtaattgttagacaagcccaggcatgtgaacaagagcttccctaccccaatctgcaaggcagacaccctgagagtgttagagttggtatgggcagggtccttcacactctgaagtatgtggttacccagcaggctggtgggcagagcatggaaaagtccgaatcaaccataatcaagtaaatggctaaggccgagttcaggtaaggccctgcctacaaatccaactcacattacctgtgcacctcattgtgcctgtgccagacaatgtgcctcaatttaacctttgcaaaacttgtctgatatggacatttgtattctcgtttgatagataagggagtaagggctcagagaatttaattaaccttcccaaggccacacagctaaatggcaggactaagattcactatcagtctgttgtacttctcaagttatctttgctctaccaaacatcccaagcaaagaagttaacatgatgtaatggtgaagagcatgggctctatagccatagcgcctaggtttgaatcctggctctgctacttactagctatgtggctttaggcaagttacttaacttttctgtgccacagttttctcatctggaaaacagggacaacagttgtatatttatcatcgtgtgattaggagaatgtaaatatgtgaatatttgtcaagtacttagaagagtccctggcgtataatgaatacatatacatgtttcatgtgtgctaaataaataaaagaaagggatcttttcattctcaccacacaagagttcattttccagtctctggactcagaagaaggtgttttgcagtttcctaacatcatggagtccgaaaagtgcttttgctacaagggtctcactttactgtcacaacagctgtctaaagaagaaaggaagattagacccatgtaacagaagaatacactgagacttgacaacatgaggacctttataaggtcatttagcaggtaaataaagagcaagaaagatccaactcgacctttctgaccctgaatccgtgctatgcccacactctaaataaaagcatgaacttgtgagtttgtggatgaaagcttggcattgcgtccaaaatgaggccatgggacagactgctgctgccatttaaccccaggtcctgagaaattcctcaacccttcccatgagtcagggactcctggattcagtgctgctgtggactgcccattatgcctctcccctgtactcaggagatggaagactctctagagttgaccactgtgaaccaaagacaatagagtgttctctttttgcacaaagaacaaaacagaacatcaagagtcttagtgatttattcaagtcacatgagttcaatgagtagggaactgcatcaagagacagcttccagttaattttatgaaccttatatgcattgcccaatatgagtgttcaaccccatggttccctgttttttttgggttttttttttttttgtcttttttttgttttgtttttttgtgcaatcaatgacctaaattctagggaagttagggtagaactagagaagacagggaagagcaaaagaaaacaaaatgtgctcagtttggttccgaggaagggtgcggaagctggatccagatggtgggggtttggggaactggataaatcaagagagttgaggtccttggaaaaactgaagacggatgttttcaaggacatagaaacatggctcgtagcaatgctcctggaggcccagcagagaccagcaatacttgatctcggggatcaacattagtgtcttaatgctggttattgtcccaaagtaagtaaggtgtgcagtgttcaagatctgtcccattccaatgatgaggaaaccaaggaccaacaagaggtgtgcattttagagcccctccccatcccaggccaatgaccacaaaaccgattctgtcccccttcccccacaggtagtgcctatgctcctgatcctcccccaatgggacaaggacaggccatttgacccaagcctgttcctcaagagattgacaataaaaatgcccacattttaaatgtgtacatgctacaattttctgattataaaatcaatacaagcttatttgaaaagaacttggatctgctggtatgtgcacatcctttcttctgcaatgaatcaaaggatttattaccaatggtttcatctgggaagattgtaggtgagaaggaagattttggattttgtttttgagctgttttaaattgtgtgtgtgtgtgtgtgtgtgcatgtgtatgtgtcaaaaagatatctgggaaatgggattgtagaccacttcgttttgtcttattatggtgtcatctgtgtctccatagtaagagagagaaagaggaaaaggagtaggttaataatcaatcttaaataatttgaaaactaaagaaaatcaaaatcaacagtaatcataccatctagatctaaaggctcatatcattttagcataccttcatgctgaaataatgaggattattctatatctaaattctaaattattcttttatttatccttattttatgttatgccacaaataattttacatatcattaaatatgcttcagaagcatccacctaatggctgtagaggggccttcctagaaaataactttttatctataaatttcatgttcattgagcacttcctaggtgtctcctgccaagcacagcttccatggcgagggttagatgacacacaccatggcacaatgtgtaaccagatggtttgatgccagagactatgtgcttaaccactttacttctacatggagcatggtttcttaagccaaccttcctctgtagcacatgtacattgttcccaattcgtcactattgaacaaccctgagatgtacatctttgtccatagatctttacatctctgagtacttccctaagtgaacacttcacaaaagagttgtttgactcataagaataaaaatgtttaaggctcttgatgcatttccctaaggaacccacttagcatctccacaacagggtttgagaaggtaaaaattagaactctttttttatttatttgtgacttatttcattacagttgagctgatttttcagtttattagccatttacatttcttagtagtcaacttattgttttatgttaactcacctcactgatacagtaataaatttggtgttcctttagtgtaggtatgggaaatttcttcaaaaatcaacaatattcttgtctggaacactgaattattttctagaatgcagatgcattgtcgacttatatgagtgctcgtcctggaaggaaacagatggtgccctgaacggggataaccgaggagagtttattatagggagcatttacaagggtgtgagcagggttaaggagacccagaagagttggtgcagcatccgggggctggcaacacagaggagccattacctcccctcagtttaaaggggagggaagagcctggagagagtagctgtggttgtcagagaagcactaggcagggcaggatgcagccaaccctcagaaggtaatactctggtgtcctcatctcttccacctcagggtgcagggtagaattgctacactatctcccatgggtctcatggtaaagcaataacgtctaaacaggaagccattaaggcctctattttgatcaaaaaaacagcctctgtaaatccagacaggatcccaggggaccagcatcccagttcagggcctaagctgtagctccaactggctccgcctcctctgtgtgtttcccttccttgatgcttttaaaggaagttgctgtcggatggaaggcaaaacttaggttttctatggcacagttttcaggaagggcaagtcactctttggctctttgggaaactccctcaccccataccccactcagaccacctccaaatgctctaggctgggtctgccatcaatccctgataacagacacccaagggagatggtgtagcaattccaccctgcaccctgaggctgcttgtctcagcatgcaagaacagcctgtgctgcggcaggaaaagtctcctcgagcctgtgaaagagacgaaggagagcagggcattacatataagccagagtgacttggaagtctgcagcctgtctccttcgaaggaagacagacaacatgtataagaataatggcttacatcaatgggccccaacctctggccacatactaagccaaccatttcatcctcatgacaatccagtgaggtagggactatttttatccccattttacagattagtaaacaagattagtaaacacagagaggttacaacttgctcaagttcgctctggtgccttgagctggtgagatggaggaagtgaaatgcaaagttaggtgggtctgaccccaaacccttcacacacatcttcgtgctgcactctgagggaaacgacatagggcctgggatagaagcctgattcagcttcaaagtattttaaatctctgagcctcagactccctctctattaagaaaattaattttttaaaagccattgattccattaatgccccccccgattgttgtaaagctcataggaactgcctgcatttccccggttatcacatgactgtaatttgcttggttgggtctctgctcacaggtcagctcaaccaagagggttcccctggtaacccatgcaaaacagcagggtctcgcctccctgccccaccacccagacatcctcttacttcttactctattaattttttctcatagcacgtaacactagctggcccattatgtgagtgtgtgtatgtgagtgtgtgcgtgtggtgtatgtagtgtgtggagtgcatgtggagtgcatgtgtggattgtgtgtttacacatgtgtactttttgtttaatgtctgacttcgcctctatatggtgagccccaggacagtagggaccttgcctgactagcccaccagagtgtccccagtaccaaaaatgacactgatacagtatggatatttgtcccctccaaatctcatgttgcaatatgattcccagtgttggaggcagggcctggtgggaggtgtctgggtcatggcctcggatccctcatgaagagcttggtgccttcctggagattatgagtgagttcttgctctatgagtgttcatgagaactgatttttgaaagagccaggcacctctctctcctctctcaccacgtaacacctgctccttttcaccttccaccatgagtggaagctccctgaagccctcaccagaagtagatgccgataccaggctcctggtacagcatgtagaactatgagccaaataaatctgctttcttcataaattactcagcctcaggtattcctttatagcaacgcaagcaatctaagacaggcaccttggcatatgcaaggtgctcaacaaatatttgagaaataaacaagcaaacaacaaatgggtagtgaatgaaattaaactgtatggtacttggcacatactagtcacaaaatgtacttataaaatttattttattagactctgaatgccaggtgacttatgataaatgagttcacataaaatgaacaaatttttgacctatcctaaacaaaacacaagagcccgtatgcggaaggggaatagaagtattccaataacttctttttgagaagagttataacaattgagtataaatttaagttatgagcttcttattagcaaaagcaaggaggtaaaccagatgagatgtcacaattctattagatgcagaaagcagtatactatcacccaatgctaatatcttatcagataccttgggtgaacaggaaggtattatggctccacttggcctcagcagatctgcttgaaagaaatgacacagcatttaaattttgttccatgtggtcgactcagtccactttctcttctttctctacatgcaagcctatataactagttccctttaggaggaaaatgcctggcttccatagttttcccttctacagcagaggtgctgaataggatgagctatgtgcccatttcctaggttgaccagacaccttctgagactgctgtgagatttcctggcagggatcagttcacaaatgtagcatgcctcttcaagagtgagaagactttgagggagatatacctgagagcactcaataattgaaaggcaagaaacaccacaaccagagcagcctcccaaaggcagggacaatctgtccttggaaacagcaaacttactcaaattagaagcctccgtgcgggtgtgtatgaatgttgattcaacccttgttaagcactgaccctcggaggtagctacaagccagagtgtcagctgcccagaagctggaaagaggtcagaacaaatgttccaatgatgtgatgctgtcctgcccctagaaggtgccccggtgcagtgggaggacctttggagcccaccaagcctggattcaaatctgccccctaacttgttagccaattgaccttgaacccttccttgcacattgttcccttcatctgcagaaggtgattgacaccattgccctgtgcagcctatcagctacaaatacaggtctggggtcaggctgcttgggtttgactcctagcttaccgatggggtgtccttgggcaagcaccttgtgttctttcttttattttctcatctataaaatgggtatagacatacctacatcctgtgactatggtaaggaccatatgtactaaaccatgtaaagcctttaacccactgatgatggaggttgcaaattttttctgtgaaaaattggaccttggcgatgaccttgaggagtaggatataaataactcccacaagcttagtgttccaataacggaatactaggtatacatgggttaagacagtgctcttaaggataagatgttacttgttttgattctccaaaatttggggcttggtgtgaggccaaaaacatgtgagtagttggcacagtgccaacacttagtgtttgcatctctttcttgcggaaagccagattcagtccaagccctgcttgggggtgagagtaaggtcccttctgcaaacccaaaaaggggtcccagggacagttggatgaggaattccaggccaaagcttttccttggatgtggcagtaagaacagagtgcactgggaacgggctggccagcgcctgcccccctgggagtcacaggaacagaaataggaagcccgggctggtatttacagtaactcttcagcccctgaccacattgtcttgtctgtggtgcatttattttggggacaagtactgaagtcattgctgcccgaaagtgctccaggcgggcccgcctgtctctgctttcccaggagagccctgaggtgagggaaccagacccacaggcaggcctggaggtgccctgagtctggaaggctgaccgcaggcccggctcaggcccctgccagagaacaggcccaggctccccaagagactttgagaggtgcccccagcaggaagctcagaggaggacgaggcggagggagggatgtcccgccccacccacccacaccctcatctcactttccttttccttcaagggctgccttggcctgccttcctggctgcgagtgctcctctctctccatttcttataattcagcagggaaaaggggaagtggattcttcaaagcctcttcctggccttgatgagcaaatgcatggtcccaggcccgggttctggcctaggcaggcctccattagccgtagcctgcctgaatgacaggcaatcctaaaatgccttcgttcctgatacctttgcttagcagaagcattgagcttccctggaggcaggcctaaggctccacctgtgaacggaggcttgatttcttcaagactgtcctatctgggaggttgctctggccagagccttaggagctacagtgcatgttgtagactatgaggctggctccccctagagttgtccagagcacaaccaaatattgtgtgctcacctctagagcttcatgaagcagaattttataaccactagacctgattatcactttgcaggcttggagagctgacactcctctatcaggttagcatttagcgagtacttcacttaccctaaggtgtgagttcatagtggcttaatccactaacattccttaggggtgtttgtgtattcactggacacaaaaactgtttaatgcccaggtttaaagggcatagctggagaatgctaggcattgtctaagacaagaaagagatgctgaggtccaggagactcccttgtgtctaacagtttattcgagaatagcaaatgcccgcctgtctgtgaccagtgttttcttggagccaagaattatgcctcttgggcattttgaccaccccagaagatatatgccatttttactgaatagaggagaggaagaaaactcagatttatcccctacccactattagccagaagttatgctagcactgtgacaaatgtcatttcatttattttcacaactacccttctgggctgttattatcacctcctggaaacaagtaatgtgaggctgaagggaactaagcatattgccttaagtgacagagcaaataagaggcaaacttgtgatttgaacccatgtctgtgtacacccagagtcagtcctcccctccctcctgccgccatcagatggaatcccatctgtgttctgggtatcagcgtcctctgaggagttcactaaaatgtgcattccagttgaaatctgaatttctaggagtcagtcccagaaatttctatgtaattcctccctgccctcaacaagggattctggtacagaacctggtttgtaaactaacgttttggaagttaggttgacgtttgatagtagaaataatctcactagcctagggaattcccacatctttgttcatgcaaaggaggatgtcttttgtcttccatccttgaaggcccaattctaatttaaccttctccaggaagccttcttggactgtttatccagcatgtggtatctcctctgtttcctacaattatctccttgtgcctctctaatgcactaaccactgcatgccttggacaggctatctgcatgcttttacctttcctagacttgaaactcctcctggacaaacctggctttctcatattagttttcatccattcacactcattatcatggaggatgccagaaacctggacagagccctagatgtaaatcaaaaagcaagcattgaaatgagttatgttggatagaatgatcaaggaactttattagaaacctatatctagatggcaaacctgcagattcctcaaaatcctcagctgcttctggctaatttgacttttatcacccaaatccctctaccagaaataatctctctctccaatatatccacctggtgaacttctcttgacacttttcaatcgtcatctccttgcaaaatcattcccactcagagcagcatttactacacctgcttctgggaaagctctgctatgctaggacccaccagaggatatcctatactttattgtatgcctttccctctgggctgcaagcctctgcaggacagaattaggccttactcatccatcttattcattcctagggccttagtgtttggacaggcacatattagtagctcatgagaagaatgaataaatgaatgaatgagtgaatgaatggaaaaataacagtagcaagtctgggtaacatctcaacagatgggtcagtttttctctctagagtcagtgtttctacaagaacataaacaaagggcagccagctcgctaccaagacccggctccacagattttcctgagagtcatcaggtagccctgggtgaaagaagaaagtccctaagatcagctccctctctacctgccagaggtgttcccaatacctaagacaaagccagggacatgatagatcgttcaaccttacctcctcccacaaggtctctctttcatagtgtttgcctactggagaaatttctcgaagtggatcctggagtgtcacaagagcccttcacaaagccattcctacaacaaaacgtggcctggcatggagctctccctccttgcttcttgtcccagagtctacgggcatcagaaagtgatatgcagggagatcccaggggcttcatcagcacgttcagagccaagtcacaggggtcaatgtttttccccatttctgctcataatcagtaacaaatgcagccatgactctgaacttgcttttctagtactttttaaaaagacctttagccacataatttttattagctctttcttatgtttttgtcatttaacaataagaaaattcccacaaattgaagccagacatgtttacatgggctatcaaaagccactatacttttatcaggttcatctttatttattcagtgtccttagctcactagtcatgggttttcagtgtctccttgttgttttgaaagccagaagatgctggcatatggtacaagttgattctccactatgcccatatgcctaaaacccctagaaagttctttgttagggagagtaggagagacatgtgaaatgaaaatctctgttccatttgcatgtattcaattgaatgtgccatcctgtacatataattaagccctgatatatatcataattatgaaactggcacaattttgtatctcattaaagtggcgtgattagaacaatagaatgtacgccgtacacctccctcctttcaggtataaaccaggccaggtttctatggtgtcttggagccttttacataatccgtctatcacagagaggacatgggctcctggaaaccacttctgatgtacagtcactgacacctactcaagctgggaccatgcccacctacttggtgctcagactcagactcaaccattcctctccatcccaggctcagtgaggagaaaaatcaatattcctaagtgggaaaagacccaataagttgctgaaaaagttacttccatttatatgtttgcttttaagtggtcctctttggggcagttaaatggcaaagtggccggagcacagaagaggtggcagccagcccagctcccctctcactaccttgcaaccccagaaaagcaaataacctctccaaaccttgcttccctgtttattagtatttatttatttgattttcttaagtttgccctttgtggtaagaaatcacctcagggcacaggcacaagagagtaacaattcattaaactacatacaactgagctgagatggctgacagcctcgaagtaagagacagccagacaagccttttttaaagctttggccccctaacttgccagaactaccgtaggagtccaagaacgcagcaaggaagcactcactagatagggagagaggctccagctcccagagatcttgggaggcgttagcagcagtgcccaggcaggctgaccatgctctaggagcaaagctcatctcaaaaatgtggaaggttggccgggtgcggcggctcacgcctgtgatcccagcactttgggaggccaaggcaggcggatcatgaggtcaggagatcgagaccatcctggctaacacggtgaaaccccatctctactaaaaatacaaaaaaaaatagccgggcatggtggcagttgcctgtactcccagctactcaggaggctgaggcaggagaatggcgtgaacccaggaggcagagcttgcagtgagcaagatcgcgccaccgcactccagcctgggtgacagagcgagactccgtctcaaaaaaaaaaaaaagtgtggaaggttctccttagctttaaaggcagtgtgggagctactgagaatctagaagaaaatctggttgagaactgactcaatcaagcaaggtctgggcactgtcaacaagagtgaccctgctcagaggcaggccagaacccccactgggtgttaaaaagaggcagaggagctcactctccctgagaattacaattgtccagcaaaggaaaatgaagtgataagctccatccccaggggaatccaagcagagatggagacctgctatgttccaggaaccatgccagggatctgcataaaattcccagggaaccagatcaccgaagttaggaggaaccatgccaagcaggtgagatacagctcagtctaacactaattcacacaacgccttctacatagaaacattttttcaagactcctttgataaagcctactgcatacgttccacggccctctgtcttttccactggacaacatatcttagatatcattctatgtccatccagtaatggggtcttcattcttttcaatggctacaattagaagcatctatcaatgtatcactttttacattgagtttccagtgatgtgcattaaggttgtttctagtgatctgttatcacaatctttgtatatatgtcacatgaaagtgtatctttaggtcacatttccataagtgaaaacactaggtcaaagagaatatgcctatggaatactgatggatacattgcctggagtgcagtggcaccatctcagctcactgtagcctcaacctcctgggcttaaatgatcctcccacctcaacctcctgaacagctgggactacaggtgtgtgccacaacacccggctttttttttttttttttttttgtagagatgaagtctcaccatgttgtcccagctggtctcaaacttctgggctcaagagatccttccacctcagcctcccaaagtgctgggattataggcatgagccactgtgcccagcctggttctttggctgtacatgccctcttcccctaaaagtctctccaggttatcaactcatatagtcagagggctgcactccccagatgaaacataaatctctgtttatggaagcccatgaacacattctgaatacttaagctcaagagaacaaagcctgaagagggaatgtctctggtctgaagtccaccttctactttcccatttctttctgtagggtctgtctcttcttcatactattcttatccatagcacccagtcctttcccttcctgaagatgcaaccctagacttaaccactagacaaacccagcagaacatattgtcccagtatccgtataagatctatacatatggtgcttcattctcggcatttttctctctctaatcactactgccttctaaagaaaatgtggtatgctgtttaacaaaaggctcatgttatgctgagcatgttgataagtttggatagacaaatattggccaaagatggagctgaagctggaaagagccaatacacaataaagccagaggaatttggagattccaagagcaacccatgaaagaggcgataaggaagagaggtagggaagggggaaaggaatcaaagagccatcaagatatcaggaggttgggagttgtgttgtctggggaacaggccagtgatgcttctccagaggtcctgggacccaaggacatttcaaacaaggaggttacctaatgtttactctgaagcagctgtgaagctgagatgtaggtgctatcttggtattcctaattgccaagccatcgttgaagtctaaagagttattacttctgtatgcgtgtaaggcaggggaatagacaatcaaggaaggagctgaccatgcctgggttaatatggcatggatcagtaagtgctctttcagaggtgaacctcagggcccaagataaccatggaaatactagcttatggggattcccactcttagcaaggacctccattgatcaagaggtccagagagtagagatttcacctgatctctggaccaaattatattgcacatttctgcacctttctccatgagggtaggccaagatggctattctcatcaccacaactcttctttcaggttgccacatggccttctccttcacttcaatcaggtctctgttctaacagaaaatcattcctgatcacctaactacagccataccccctgccccaccttctccaccccctaaccctgtcacctagcattgtatatttgtttatccccttattgttttcctccctccctagaacataagccctgtaataatgggaaacttctcacctttgtcttcttggtccccattacctagaactatgtctagcacagagtaggtactcagtaaatatctgtagaatttattaagcaagccaagaatgactggagtacataaacatgaaaacatttggacgttgtttaaaactaagcagattactatgttgagtgtctcgatgtagctgagaaaacaactatttcataaggaacagagtgaaataaaagtcgaagggtttaaatttttttaattagtccttttattctcatgttttgcagactaatagcaaccacggacttagacacatagaaggattttatgaattgcacatctctcagcagggtctgactgcctgcatggacagggagggtgagtcccagtccagataaccatgaacatccatgagtaattatgaccaagatcctattaccaagccaaaccttgcactaggagttaggcatgtgttactgaggtcagcagttggctcttctgtccactgttttgtgccagcccagacaacttaatgctctaccagtgattatacaaattgtgctctcactttttttttcaattacagaagtagagaacatgtcatgatccatacggagaaggaacagagcactgagtttaatccaagagttgtctgcatttccatcatcaaactattacttttccactcatcctgacccaccaccattctcccactctgtgttcagaacagccatcactgcagagtaagatgccattagctagccattgaggtcattagctgcatccacacagaagagcagggaggccaaaggcagcctttggaaatcatactcaagctaccaaagtgaagagaaagcccctggagattcaggggaacaggatctctggcccaaataacccacagctacacgaagagatgcaaggaactgagcagctacttcatgatgtaagacatgtagatgaattatctaaattactcagagtacctgtctacacagcctcagcttacttgagaattgttcttccaggcttcattgaagtcatgaaataaataaaaagccatggaacataaataaatatcatagaaacccctcccaatatatggttgctctccttagagggatggtgataaaatcaagtctgcattcctttatagcatgcatcagtgttaacaacccagcattgtttaagtgaatttgacacatatctgtgcaaataaattaatactctcactttgactgatttttggcagaaacaaacaggatgccatgccaatttatgagttgacctgttacaagagcccttctgaaaataataaaataaaagccatgcaaagtacttcaatatatcttaacaccaaaattaaagaagtcagcttttctttttccttttctctctgttcacctaaagtcctctgacctgttaaactgtgtaatacaaatgtgctagtgatagcagttgtgagaggaagaataaaggtaacaggaaatgggcagggagcaggcaggagatgcatgtaacaatttatcaagggaagagaatgacacctcattgtctatattaagaagagctagaaataaatcaataaaccatttatttattcttcctgaacatccaacatccaatattatagcataacatatatctttccacatgtccacactaccttttttaaagagtagagtcaaaattaaccaaatagccaatttataaaaacaaaagcgttgagagtgacaaatttgatcaccttttcctatcacttcagttgattaaatattatgttctgctttttgattatttagtctataaacaaaaaacataaatacagaagtcaatgaatttttgtctatttataagtaactatccacgtccatagcttcaggaagttttctcatgctccttactgggcaatatccacctcctaccccagagtaactcctttcacctttgtgaaagggtgagagtgacagcggtgttgttgtgtaaggtatgattccaattatataaatttcaagtaagaggaaaattaaacaaaagtgaaagaaggtgacttctttagatattagcaattttactacctttggatattgataaataccttgacctataagattaatacagtttaattataatctataggattcagatacttatcttaatattaatatttttagattgttagctatctcttgagcttgagtttttagatattagtaattttcctcattctcaaattttatattactggaatcatacattatgttctctcttgtgtctgtcttctttagcgcaatatggtatttataagatccatccattttgtggcatatatccttagtttactaatttttattgctgtgtagtattctaccatatgaacacaccacagtctgtttattttcctgctgatgagtatttggggctattatgaaacggctgctgtgaacattcttgtacaagtcttttttgtgaacatgtacctatgtatgaatttctcttgggaatgatttctctagttcataggataggcagatatttaactttattcaaaaaagccacagagttctgcaaggaggttgtaccatgctgtcatttgcttttaaaataactacgttttgaccaaatacaacttatatccacatttcttgtttccttacctcctgtgaatagtttattcatggacatacagatgttggggatggcaggataccatgaaagaacacaacaggctttggaatgaacttcagataagcttcaaaactcaatctccccactcactagtttacagacttgaatcaaaattttacttttaggccaggtgggtggctcatggttgtaatcccaacactttgggaggccgaggtggaaagattgcttaaattcaggaattcaagacaaatctgggcaacagaatgagacccccatctctaaaaaaaaaaaaaaattggctgggcgcggtggctcaagcctgtaatcccagcactttgggaggccgaggcgggcggataacgaggtcaggagatcgagaccatcctggctaacacggtgaaaccccgtctctactaaaaatacaaaaaattagccaggcatggtggcggccgcctgtagtcccagctattcgggaggctgaggcaggaaaatggtgtgaacctgggaggcggagcttgcagtgagcccagatcgcaccactgcactccagcctgggagacagagtgagactctgtctcaaaaaaaaaaaaaaaaaattcaaattagccaagtgtggtggcatacacctgtagttccagctacttggaaggctgagatgggaaaatcacttggacctggaaagtcaaggctgcaatgagccaagatcatgccactgcactccattctgggcaacaaagtgagaccctgtctcaaaaatatatatatatagattatttttaaacatgtcagtctcagtatttctttgtaaaatagcaacattatctattactctataggcttgctgtaagaatgaagtgaggtgagacaggtgaaaatatctagcacaggttcagccatgtggcaggcactggataaaagcaaattcccaagtctccctgcattccctgagcttgacgagcatctttgctttggggtgttaagaaattctctctctctttctctctctctctctctctctctctcctaggccccagagactggggagcaaggaggtcaggaaaagaaagaccctgcagaatggaaggtcaagggaccggatgaggatgaaaatccaccctccatggcagaagggaaaagctctatttacagtaggacccagatggaactgatttgttcagagccatcttattcctgagtgtgatatttgtccacatcataaaaccacaggctacaatgtgtctgacattataccaagtgatataaccccttctaatgatattataataaatcccaaatgaggcagccatcactgggcagccttttcaaagtgttcctgaaatagtttttacagaacaagggatctgcatgccaaatgcagaggctcacatgaggccagaggagttagctcaggcatacacatgaacacaactgtggcttagttcttggctgggaactttttctttctgtattaatctattggtttttatgaaagtcaaaatgttttttttttttacttttttatatgaaggatgaacttggatattttctaagtgcaataaaatgtcccccagggtgctttttttattattattctttaaatcagcagtttttgtgcctcttcattagtacaagtcaacgacctttcatcttggcttcacctccaagaaagctgaccacacttcctgccatcctggtggtagaagcttgtttttctctgttgttttgctaacatgcataggtatatttctgagataccatgtgatctgcttccacaagcatagggagcttgctgactcaggaaccattgaatttttttctaggacaaacgtgtagccctttctgcccttaaaggcaagaaccgcaggaaatcatgtgtctttactaatagggttgcatacaccatcctcctggactgtgctcttagaattagtaggatctggaacaaaaaggagtatctctcacgatcaccagtaccccaccactaccataaccagcgtcaccatttccatgactggattcacaacaacaccactgttactctcaccctcgtcacttcccttgcctgtctttcccacataattattcttctggccattcccactgcagtggataatctattgtctgcatcttcccaacacacctctttccttccctttccccatgtcatgtggttccatcactggtccaaaatttgagcccaagatacgaatacatctgttttactgatattgggaaagactctttttttattctgtcactggaatcacaaggctggtctgggtaagtctaaaattgctagagattactaattgccaacaggagaaaaagagcttatttaacatgaaatatacaccgaagggagcaaatcagaaaagagggggaaaaaaagagagagaagctcttttaaaattgttgagccacctggattcagccatgcccatagttttagttatttaaaatgttaattgttttgcttacactgctttgaattgggtttcttttggcataaaaatgaaaggatttgactaaaaccaccctccctgttacctggttcatatttcccacctctattccaactacactccagcttggcatcccatatcaaagtgtttgctggcaagccagggcctggggttgagattctaagggataactatgatctcctacctaagtaagcctaaagatgaagctacatttcttaagggaaagcaagtccttcatgccaaggagactaaacacaaacttcaagcctggaacaattaggataacaccaagtttaaaacaagagtaaaagacctgagataattgttcccgacactaacagagtacaggaaatttcctttatggactagcattttggttagtgaagataggagggtgacttagcaaatacaaaccaagatggaaggtaccactttcaccagcatcacagtccaccaagtatcaacagcatcatggtggctgtcttgcatttcatcttttactgggcatttagaattcagcagatacaaaaagggcctctactttgcaggagtatatattcccacagggtggaaatacagaaagacaaattcaacaaataaactttcacaagcaacaaaaagctatttgtccccaaaagagtggctaagatacgaggtgaacattaatatacatttggagatgtttgggtctttcttttcataggattggccatctttagaaggcaattattttaaaatagcattctgtttcctctggtggtacatttctacaccttccacaatggtactgcttttcaatgctttaaaaaccacagtagaaacacaaagaaggatatgtatgcattctcattttcttgtaccttcctccccaaaatcactttcaccaccattctcatcacttctactaccactagaatggcacaatcctgggacataggctgggaagaatgatacatcttttctcataactgataatgcttgctgataacatgtactctcttcctggttttaaaactaatgtatgtcaattatgtatttgttaaatacatttgtttacaagtagcaaaaaccaactgaagacaacataagccttgaaggggcctatgatagaaggccataggagttacttgagaacctaaggtgcaggctccagccagtcctccaaacagactggacccaggaagtcccagatatgccccttctttctgcttctctcagagtcttttgctccaatcttctctcattctatgcactagctttctcctagcagttcccagaggatccagagcctagacagccaaagcattgaaaaccactgtgaaagatttagaaatgtaccaccagaggaaacaaaatgctattttaaaataattgccttctaaagatggccaaccctatgaaaagaaagacccaaatagctccatttcattttcttctgggtgctactaatggaaagcagcctagtacggtggatgagagctgactccacattctgctagctgcatgactttgggtaagctttgccccttgcaaaaataaaaagaaataaggccctcttcagaacaatgttcatccatggaaaacactctgtgagcaggggctaacataattattaatacaaaaggggtagatgaccagttcttttgattgaaaacacgctgaaggattgtggacattcaaagataaggcagaagatacctttaaaattaggaatcagatattatagactcactccaattaacaaagagagaagaattccaagtttcccagaacaaactgggaggagagaaacggagagagagaaaagtagtatggcaagagaaggaagcttaacatggtatagtgttacccatgtggagagccaaatggactttgaataacaggaatctaatacaagggatcttaatccagggcccatggatcccaattgatatggagataaaattcagggagtccttgaactgagttgggggaaaaattacagcttagtttcaccaacctccaactaaaaattaacattttcttcaattataaatgtaggcaacacatcacaatagttattggtaacttttgtggctttgcaatcaatagaaatcacagatggtctcatgtcatattgtagttgttgaatacatttcaagatatcatttatacttatcattactttaatattatactcaatttctgtctaacctgtgtatcatgttactgaatgcattattaataaagaagcactttacatcactgtattaccagtttgctttttcttaaatatttgataactttatttcaacataattcattttctttataatcctgtacattttattgcatgaatttaaaaacataatatttgaaagggtctatagttttcacaaaactgccaatagggtccatgaaaacaaaaaagaaaatctttaagtatctctgatataatataggatgtattcatcttttatatggtatatgataataacccttctcttaagccatagatctttagtaagagtctagtatggtacatgcaagagattcatattccagattgtttgaaggaggactggaggtagaaataaaagagaaggaactatgccccatgcattggttaagctaccagatcagagatataagaaccacacactttgggaggccaaggtgggaggatcgcttgaggctcggagttcgagaccagcctgggcaacgtagtgagaccctgtctctacaaaaataatttaaacacacacacacacacacacacacacacacacacacacacacacacacacaaaagagagaatggaataatggaattctaaagataagaagtcactatcagaggtgatgatgagaatgcaagtcctcaaggatccacacaactcattaggaagatgtggactttccacaggacatgggatggcagttaaaatccgcactgtctaactcaaaagtggcaggttggccccaaactgacacctgtggctttaataatataaagaccaccagtaacccaagcaccacccagaaataattaccattattatgctcatataggtcttccagttatttttctgtatatgcatacatgtatggtgttgtattcatatgaagaaaagtttattgtattaacatatatgaatacaatcaattttcaaaactagactcaatgaaagcacacaaatcttactttttaaactttgtcatgcccaaaatataatttttgtggttatatcatgtttcatcatatggagatgccatctgctgtcactaaatcctctaatatttgacatttacattgtgtttaatatttcacttataaataatgctatacagaaaaattcttatacataatttttattaaactgattatttccttagaataaactccaagttatagaaaaattaggtcaaagtctactaacactttaccactcatgaaattcattgccaaatcattttttgttacaatgttaatagcctcatcggcaatgtgtaaaaaactcactttgccatctttttcatcactgcatattatccttttttaaaatattattttttgtttttaattataaggcatgtttgtagctaacttggcaaagttgtctgcaatagtacttctcattgctgcacgcacccctcctttgcaatttgacgttgctgctccttctatcaagttgaatgacatgacaggaaacagaaacaagtgtctcagctagggtcctctagatcaaccggcccccagcaaatccaccagctgactgcaatagaattgtgtaactgtgggcaagaccaacagaagaaacacccagctgagcacagcccaaattattggccctcagagtcatgagtcaatagaatggttgttattttagccactaagttttgggttgatttcttacatagcagtagataactgatataatgttcacttttgtcataaaaatgtatattaaattttagggaaaagtagtaaaatgaatccagtattccaccatccaacatagaagagaccactgctaacaatttgatgtattttattcccatctcttttatgtcagtatgcatgtactatatggatatcagaactataaactaaccttgcttttaaagattgttacaaaaattctacaagcacaccagcaaatgtaattcattaaaatattaaaaacagttatttaaaatcactaataaagagattatttaatgctattaatgagagctatttaatgctattatttaatgatacattacaaatatatgtatcaggtcaatgaaagtgcaattatctggataaatattaataagtaattggtaagtttgatgtccattttttaggaaaaaaaatcatagaatataaggaataggaaaattcaaacctaatatgacatgattaaaatgtctaccttgaaagcaatagtcaattttatacctaatggcactatataagcggcattgctattagaagtaggagcaagtcaagaatgttccctacaatatcatcactaataattgctctggaaattctagttaaagcaataaaacaagaagaacattgaaatgtaactattagaaaaaagaaaatgaatttatgaacacttactcatgacattaccacacatctcaaatcctaagacaatcaaataaaaatgtgttaatttgaagattgagtataagggcttgatataaaataaatatacattttttcaaaattgcaataataacatattagaaaactaatggaaatctatcatctttgtaactttaaaaatatttaatacctcctatatgtaatttaaaatataaatcatctagaaataagctaattactaaatgtggaaaaaaaagaatgagcttacataactgatgacaaagagattgtctattaaattatggtgtgtccataagtaatactacccagtcattaaaaatcgtgtttttgaagaatgtttaaaaacttgtcaaaaagttgtaatatagggttaggaaaagattcatgatacaaaatactatatgcaatatcatctcaaatgtgtgtgtgtctctgtcaacatctgtctctgcttctaaaaagaggtcaatagaaagagacctgaagacaagctgagctgttgctctggctccctcatctcagccaatggcttgttccccaaagctgcccccaagaccacagcctggtgccaacgatgcgtgacatcctctattctactttggaagagaaccagcctaacaagcctctacagtccctgtcacagatggagttctttacagcagagatgagcacctggccttgggaaaccagagaaacaggtcaactgaatgggtcaccaccatcagtgttctgtaagcgtgagaactcattcttcttcagccttcattgtgcctggagatcatcatcaccatcaccccatggtcatcaacatgcttgggcttcccaaaaagaagcccaaggctatatatccaagcagattggactatttgctaaagatgagtctaactgattcaacataggtatgcttccccttgctgagaaactgaggcatctatgacataaataaggtaggtgaacaaagcccactgaaagtcagattgactggtgttcaaatcctggttctactacttcccagctctgggatttggggcatgttactaaatctctatgaacctcactttctacattgtagatgtaattagtaataatatgtaccttacaaggctggtgtgagaattaaagaggatatagcatcgcaccacttatttcaaggtaataaatttaccttggtctccaaaaaggtaaaaaagtgaacgagagcttgggcttctaataaaaagactgttgttggaggaaactcagactcaccatgagtcacttcaaatgtgctgaggctgtggaactgcagaggctatcagtgcaatgtgaatggtacaaagttgggtcccaaacacagggctggaagtccaccagtatctcactgcccatgatgggtaggattgccaggagtagcaaataagaacacagggcagttagattttatttctaataggcaatgaattattaaaatgtggggtataaaagcatgtcccgaatgcataagtatgtatttttcttctgttcattgatacatcccagacccccagactatgcctgacatgtagaagacacttaataaatatttctctaccatgaacaaatttctgaatatgtaggcaggaccccacgaacggtatgaaataaaagatttataataggaattagccctaatatgactgttggagctggtggaaaagtgtacagaaggctatagactctgcatctggtggtggatctgaagttgctacaggctagcagggttggcaatcaggatatcaaatgatgtgaagaagaggagaggaaggaactgggatccacatctctctctctccatgtctaaccttgacaactggtaactttcagaagaagcagacaccatttgtcatagagctgcacatatacctgaaccaggctcagagaaactgatcaacaagatccagtggaaggagctgatcagcaaaatcatacaagggctgtagcagtgtgtggagccctacactttccatgattgcgttaatgatcttcagagtaaaatgagagctgcttcctttccaccttcctcgtctcaggtaaatttctcttgtggccaaccctaacctagaaccatacaaggaggggaatgtggggaaacatagttccatctttgctaaattggcacagttcaaaaccatcaccatctaccctttgctcaacttggcatccgtgcataactcttttaataatacccaaataaagacaccagcaaagtcatatttctgcttaacatgatccaactattcttcaaacagttgaaaacatgctatcaccccaaaagaggatacaaagtcccacatgtcactttagccatctctgggtaatgttcattcatcttgcagctaagccacacctagtcacacccttttgatattctgtaagttaaatgcagagttacaaggtttacttctcttaatgtgtcttgcatttgatggagagagaatgagagtggagaaaaagaaaagacttggttaatacaaatataattatatcaaaataatgaagaaatattcataattactataggccttatttcttcaactggtcacgtggccatggctggtagtcctggtgcactcctaccatccttttcacactccctttgcaatgagcaggtagcctggctcatcatgctttgttgcctgataaagtgacccaaagcttcattcctgaaggatctgggttgtcagctgtcccgcctgtatttggtcatggtggtttttcaacttttatcaccagacttggaaatactaatgggtgccccagggaatgccctacattccagacatactccacttacccatattacgtagtagcaacccagtcactccttggtattcaggatcagtcaccctagccagcacagtaactcccttctttgtgggtccactcagggacatgaggaggccaaggaggccaggaagcagtctcaacttccctctaattaactgttattgtgccccttttgggggagcacttctcccctgggggtctaagtcttcttggttaggaaaggttaggctgggtacggtggctcacacctgtaatcccagcactttgggaggccaagacaggtggatcacttgaggccagtagttgaagaccagcttggtcaacatggcgaaactccatctctactaaaaacacaaaaattagccaggcatggtggcaggtacctgtaatcccagctactcaggaagctgaagcaggagaatcacttggatccaggaggcagaggttgcgatgggctgagattgtgccactgcactccagtctgggtgatagagtgagacttcatctcaaaaaatgaggaaagacaggttaaattcacagggaaggatgcaaaaactttgctctcagactactagggtaatagtaagaggagttcattcccagacctatgaaacctggctgtggcgaaaccatcactgattattccagccccacaaagtgctaccacccagtcagtgccataaagtctccaagtggcttattccagaatcctatcagccacttgctttgggctgatggaggacattgaaaggccagtgaatttaatgagcatgagccaatggctgatcttcatttgctgtcagatgagtcccctggtcagaagaaatgctcctggaacactgatggtaaagagggccctctgagatccgtggtggtcctggaagcagcatttcaggcagagaaaacaagtctatttctagagtaagtgtcagttcccatgagaacaaagcactgctccttctatgataaaaataattcaatgtaattaccctaccaccaggctgatccccaggggaaaagtgccatattgaggaatcagagtgggtcactcctgttagtaggtaaagcagtgagcagttgtcatagccagagacagcagccttgaggagtgaaagtccatgttgctaagcccatgcaaaacctccatccccgccaccaaagccatttagttgatgaattatagacatacaagtgacagaggaggcaccaagagactcctgagttacatctcgttgttctgtgagcacaagcacaaagcaggaagtaggaaacggggctaataggaatacggaagactcgggactttagagaacaggctgaagtgaccagaatttatgatttcccatgggtgggtcagaagagtcaagataatatcaacatcttcctctgtattctggaagcatctcaaatgagcacagaatctgtaagggattaactgtgtgatctattctgacatcctgctcagcaaatgtgccccagaggagagaacttgccccatccccactcactggtggcaggattttggggggacccagaaagaggctggtacatcagagctcatggagctcccctttggcccatgtcctttgtgatattcatagaccattgatggctccttcataatggacctcccagaacacaaaccaaagcaaagcaaagagttctatacctccctcacttccaccttacccaagcttt
